(12) United States Patent
Hopkins et al.

(10) Patent No.: US 9,315,771 B2
(45) Date of Patent: Apr. 19, 2016

(54) SALT TOLERANT ORGANISMS

(75) Inventors: Shane Edward Hopkins, San Diego, CA (US); Tanya Joy Shin, San Diego, CA (US); Melisa C. Low, San Diego, CA (US); Yan Poon, San Diego, CA (US); Alvin Aram Cho, San Diego, CA (US)

(73) Assignee: SAPPHIRE ENERGY, INC., San Diego, CA (US)

( * ) Notice: Subject to any disclaimer, the term of this patent is extended or adjusted under 35 U.S.C. 154(b) by 989 days.

(21) Appl. No.: 13/496,017

(22) PCT Filed: Sep. 15, 2010

(86) PCT No.: PCT/US2010/048991
§ 371 (c)(1),
(2), (4) Date: May 18, 2012

(87) PCT Pub. No.: WO2011/034968
PCT Pub. Date: Mar. 24, 2011

(65) Prior Publication Data
US 2012/0288918 A1    Nov. 15, 2012

Related U.S. Application Data

(60) Provisional application No. 61/242,574, filed on Sep. 15, 2009, provisional application No. 61/301,735, filed on Feb. 5, 2010.

(51) Int. Cl.
*C12N 1/36* (2006.01)
*A01H 13/00* (2006.01)
*C12N 1/12* (2006.01)
*C12N 1/20* (2006.01)

(52) U.S. Cl.
CPC *C12N 1/36* (2013.01); *A01H 13/00* (2013.01); *C12N 1/12* (2013.01); *C12N 1/20* (2013.01)

(58) Field of Classification Search
None
See application file for complete search history.

(56) References Cited

PUBLICATIONS

Singh D.P. et al. (Current Microbiology, 2002, vol. 45, pp. 165-170).*
Gutterson (HortScience 30:964-966,1995).*
Bruening (Proc. Natl. Acad. Sci., 95:13349-13351, 1998).*
Elomaa et al. (Molecular Breeding, 2:41-50, 1996).*
Colliver et al. (Plant molecular Biology, 35:509-522, 1997).*
Emery et al. (Current Biology 13:1768-1774, 2003).*
Nunes et al. (Planta 224:125-132; 2006).*
Pratt et al. Journal of Biological Chemistry (2009) 284(27):17897-17901.
Sawitzke et al. Recombineering: Using drug cassettes to knock out genes in vivo. Court Lab Protocol. pp. 1-14 (2011).
Tymms et al. Methods in Molecular Biology (Book 158) Gene Knockout Protocols. Humana Press 2011.
ISR and Written Opinion from PCT/US2010/048991, dated Feb. 1, 2011.
Mohr and Perrimon, RNAi Screening: New Approaches, Understandings and Organisms, Wiley Interdiscip. Rev. RNA, 3(2): 145-158 (2012).
Rettig and Behlke, Progress Toward In Vivo Use of siRNA-II, Molec. Therapy, 20(3):483-512 (2012).
Pratt and Macrae, The RNA-Induced Silencing Complex: A Versatile Gene-silencing Machine. J. Biol. Chem. 284(27): 17897-17901 (2009).

* cited by examiner

*Primary Examiner* — Vinod Kumar
(74) *Attorney, Agent, or Firm* — Sapphire Energy, Inc.

(57) ABSTRACT

Disclosed herein are transformed non-vascular photosynthetic organisms that are salt tolerant, nucleotides and vectors useful in conducting such transformations, and transformed strains produced by such transformations.

57 Claims, 41 Drawing Sheets

GGTGTTGGGTCGGTGTTTTTGGTCTTGGTTGGGGTGTTGGTGGT

———————— Primer 1 ————————▶

GCTGGTGGAACATGTCAACATGCCCAGGAAACCAAGGCGCGCTA

GCTTCCTGGGCGCAGTGTTCCAGCTGCAGTAC<u>ACCTGGTCCCGCT</u>
                                                             | miRNA* |

<u>ATTTGAATCTCGCTGATCGGCACCATGGGGGTGGTGGTGATCAG</u>
| miRNA* | loop |

<u>CGCTATTCAGGTAGCGGGACCAGGTGTACTGCAGCCGGAACACT</u>
| loop | miRNA |

GCCAGGAAGGAGGGGGAGGCTGGGTGGGAGAAGCGGTGTGGG

GCGGATTAGCCTTGGAGACCGATTGCTTTGGGTTAGTTTGGGCT

GGCATAGTTTGGGCTGGCTTAGTTACACC (SEQ ID NO: 247)

◀———————— Primer 2 ————————

*FIG. 7*

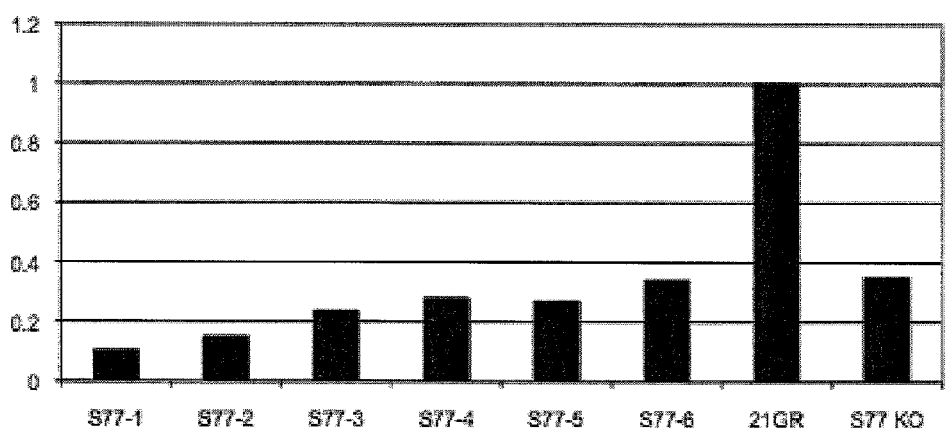
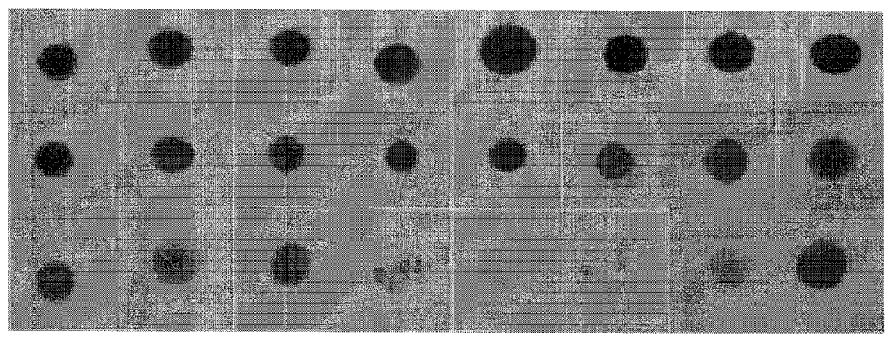
*FIG. 39*

SALT TOLERANT ORGANISMS

CROSS REFERENCE TO RELATED APPLICATION

This application is a national phase under 35 U.S.C. §371 of International Application Number PCT/US2010/048991, filed Sep. 15, 2010, which claims the benefit of U.S. Provisional Application No. 61/242,574, filed Sep. 15, 2009, and also claims the benefit of U.S. Provisional Application No. 61/301,735, filed Feb. 5, 2010, the entire contents of both provisional applications are incorporated by reference for all purposes.

INCORPORATION OF SEQUENCE LISTING

This application contains a Sequence Listing which has been submitted in ASCII format via EFS-Web and is hereby incorporated by reference in its entirety. Said ASCII copy, created. on Jul. 8, 2013, is named 0742US_UTL2_ST25.txt and is 897,057 bytes in size.

INCORPORATION BY REFERENCE

All publications, patents, and patent applications mentioned in this specification are herein incorporated by reference to the same extent as if each individual publication, parent, or patent application was specifically and individually indicated to be incorporated by reference.

BACKGROUND

Algae are highly adaptable plants that are capable of rapid growth under a wide range of conditions. As photosynthetic organisms, they have the capacity to transform sunlight into energy that can be used to synthesize a variety of biomolecules for use as industrial enzymes, therapeutic compounds and proteins, nutritional, commercial, or fuel products, etc.

The majority of algal species are adapted to growth in an aqueous environment, and are easily grown in liquid media using light as an energy source. The ability to grow algae on a large scale in an outdoor setting, in ponds or other open or closed containers, using sunlight for photosynthesis, enhances their utility for bioproduction, environmental remediation, and carbon fixation.

SUMMARY

Provided herein is a non-vascular photosynthetic organism comprising at least one mutation in any one of SEQ ID NO. 115, SEQ ID NO. 116, SEQ ID NO. 122, SEQ ID NO. 201, SEQ ID NO. 129, SEQ ID NO. 202, SEQ ID NO. 206. SEQ ID NO. 133, SEQ ID NO. 198, SEQ ID NO. 200, SEQ ID NO. 204, SEQ ID NO. 203, SEQ ID NO. 135, SEQ ID NO. 134, SEQ ID NO. 166, SEQ ID NO. 162, SEQ ID NO. 169, SEQ ID NO. 168, SEQ ID NO. 170, SEQ ID NO. 175, SEQ ID NO. 127, SEQ ID NO. 230, SEQ ID NO. 231, SEQ ID NO. 233 and SEQ ID NO. 234 or a sequence having at least 95% sequence identity to any of the preceding sequences, wherein the at least one mutation comprises one or more nucleotide additions, deletions and/or substitutions and the organism has an increased growth rate in an aqueous environment containing between about 75 mM and 275 mM sodium chloride as compared to the same organism without the at least one mutation.

The at least one mutation can be in a coding region where it may result in one or more amino acid additions, deletions and/or substitutions. The one or more mutations can also be in regulatory regions such as a 5' UTR region or a 3' UTR region. In one embodiment the at least one mutation is located in a promoter region.

In one embodiment, the activity of a protein encoded by any one of SEQ ID NO. 115, SEQ ID NO. 116, SEQ ID NO. 122, SEQ ID NO. 201, SEQ ID NO. 129, SEQ ID NO. 202, SEQ ID NO. 206, SEQ ID NO. 133, SEQ ID NO. 198, SEQ ID NO. 200, SEQ ID NO. 204, SEQ ID NO. 203, SEQ ID NO. 135, SEQ ID NO. 134, SEQ ID NO. 166, SEQ ID NO. 162, SEQ ID NO. 169, SEQ ID NO. 168, SEQ ID NO. 170, SEQ ID NO. 175, SEQ ID NO. 127, SEQ ID NO. 230, SEQ ID NO. 231, SEQ ID NO. 233 and SEQ ID NO. 234 or a protein having at least 95% amino acid sequence identity to a protein encoded by any of the preceding sequences is decreased by the presence of the at least one mutation as compared to the protein without the at least one mutation. The activity of the protein may be decreased by at least 10%, at least 20%, at least 30%, at least 40%, at least 50%, at least 60%, at least 70%, at least 80%, at least 90% or 100% (i.e. inactive).

In other embodiments, the organism with the at least one mutation has a growth rate that is at least 10%, at least 20%, at least 30%, at least 40%, at least 50%, at least 60%, at least 70%, at least 80%, at least 90%, at least 100%, at least 125%, at least 150%, at least 175%, at least 200%, at least 225%, at least 250%, at least 275%, at least 300%, at least 325%, at least 350%, at least 375%, at least 400%, at least 425%, at least 450%, at least 475% or at least 500% greater than the organism without the at least one mutation.

In further embodiments, the presence of the at least one mutation results in a transcription rate of any of the preceding nucleotide sequences that is decreased by at least 10%, at least 20%, at least 30%, at least 40%, at least 50%, at least 60%, at least 70%, at least 80%, at least 90% or 100% (no detectable transcripts) as compared to transcription in the same organism without the at least one mutation. In other embodiments, the presence of the at least one mutation results in a decrease in the translation of a protein encoded by any of the preceding nucleotide sequences by at least 10%, at least 20%, at least 30%, at least 40%, at least 50%, at least 60%, at least 70%, at least 80%, at least 90% or 100% (no detectable translation) as compared to translation in the same organism without the at least one mutation.

Another embodiment provides at genetically modified non-vascular photosynthetic organism comprising at least one RNAi agent comprising an antisense nucleotide sequence that is complementary to mRNA transcribed from any one of SEQ ID NO. 115, SEQ ID NO. 116, SEQ ID NO. 122, SEQ ID NO. 201, SEQ ID NO. 129, SEQ ID NO. 202, SEQ ID NO. 206, SEQ ID NO. 133, SEQ ID NO. 198, SEQ ID NO. 200, SEQ ID NO. 204, SEQ ID NO. 203, SEQ ID NO. 135, SEQ ID NO. 134, SEQ ID NO. 166, SEQ ID NO. 162, SEQ ID NO. 169, SEQ ID NO. 168, SEQ ID NO. 170, SEQ ID NO. 175, SEQ ID NO. 27, SEQ ID NO. 230, SEQ ID NO. 231, SEQ ID NO. 233 and SEQ ID NO. 234 or a sequence having at least 95% sequence identity to any of the preceding sequences and in which the organism has an increased growth rate in an aqueous environment containing between about 75 mM and 275 mM sodium chloride as compared to the organism not modified with the at least one RNAi agent. In certain embodiments, the at least one RNAi agent is a microRNA (miRNA) or a small interfering RNA (siRNA).

In one embodiment the activity of a protein encoded by any one of SEQ ID NO. 115, SEQ ID NO. 116, SEQ ID NO. 122, SEQ ID NO. 201, SEQ ID NO. 129, SEQ ID NO. 202, SEQ ID NO. 206, SEQ ID NO. 133, SEQ ID NO. 198, SEQ ID NO. 200, SEQ ID NO. 204, SEQ ID NO. 203, SEQ ID NO. 135, SEQ ID NO. 134, SEQ ID NO. 166, SEQ ID NO. 162, SEQ ID NO. 169, SEQ ID NO. 168, SEQ ID NO. 170, SEQ ID NO. 175, SEQ ID NO. 127, SEQ ID NO. 230, SEQ ID NO. 231, SEQ ID NO. 233 and SEQ ID NO. 234 or a protein having at least 95% amino acid sequence identity to a protein encoded by any one of the preceding sequences is decreased as compared to the protein in the same organism which is not modified with the at least one RNAi agent. In certain embodiments, the activity of the protein is decreased by at least 10%, at least 20%, at least 30%, at least 40%, at least 50%, at least 60%, at least 70%, at least 80%, at least 90% or 100% (i.e. inactive).

In additional embodiments, the growth rate of the organism is at least 10%, at least 20%, at least 30%, at least 40%, at least 50%, at least 60%, at least 70%, at least 80%, at least 90%, at least 100%, at least 125%, at least 150%, at least 175%, at least 200%, at least 225%, at least 250%, at least 275%, at least 300%, at least 325%, at least 350%, at least 375%, at least 400%, at least 425%, at least 450%, at least 475% or at least 500% greater than the same organism not modified with the at least one RNAi agent.

In further embodiments, the presence of full length transcripts of any of the preceding nucleotide sequences is decreased by at least 10%, at least 20%, at least 30%, at least 40%, at least 50%, at least 60%, at least 70%, at least 80%, at least 90% or 100% (no detectable full length transcripts) as compared to the same organism not modified with the at least one RNAi agent. In other embodiments, the presence of a protein encoded by any of the preceding sequences or a protein having at least 95% amino acid sequence identity to a protein encoded by any of the preceding nucleotide sequences is decreased by at least 10%, at least 20%, at least 30%, at least 40%, at least 50%, at least 60%, at least 70%, at least 80%, at least 90% or 100% (no detectable protein) as compared to the same organism not modified with the at least one RNAi agent.

In any of the above embodiments the non-vascular photosynthetic organism may be a cyanobacterium or an alga. The alga can be a microalga or a macroalga. Non-limiting examples of microalgal species include *Chlamydomonas* sp, *Volvacales* sp, *Dunaliella* sp, *Scenedesmus* sp, *Chorella* sp, *Hematococcus* sp., *Volvox* sp, or *Nannochloropsis* sp. Particular examples of microalgae include, but are not limited to, *C. reinhardtii, N. oceanica, N. salina, D. salina, H. pluvalis, S. dimorphus, D. viridis, N. salina, N. oculata* or *D. tertiolecta*.

In any of the preceding embodiments, the concentration of sodium chloride in the aqueous environment is between about 250 mM and 100 mM, between about 200 mM and 100 mM, between about 175 mM and 75 mM, between about 150 mM and 75 mM, between about 275 mM and 100 mM, between about 275 mM and 150 mM or between about 275 mM and 200 mM.

Presented herein are non-vascular photosynthetic organisms, for example, algae that are engineered to be salt tolerance.

A salt tolerant alga as disclosed herein is transformed "knocking down" or "knocking out" one or more polynucleotides that encode one or more proteins (see "Nucleic Acid and Amino Acid Sequences"). Algae that include one or more knock out or knock down genes that confer salt tolerance can be grown in concentrations of salt that can deter the growth of other algae and, in some embodiments, other non-algal organisms. Also provided are algae transformed with a polynucleotide that encodes a protein that is toxic to one or more animal species, such as a gene encoding a Bt toxin that is lethal to insects.

Algae with one or more polynucleotides are knocked out or knocked down to prove resistance to salt are in some embodiments grown on a large scale in the presence of high concentrations of salt for the production of biomolecules, such as, for example, therapeutic proteins, industrial enzymes, nutritional molecules, commercial products, or fuel products. Algae transformed with one or more toxin genes that are lethal to one or more insect species can also be grown in large scale for production of therapeutic, nutritional, fuel, or commercial products. Algae bioengineered for salt tolerance and/or to express insect toxins can also be grown in large scale cultures for decontamination of compounds, environmental remediation, or carbon fixation.

Provided in some embodiments herein is a salt tolerant prokaryotic alga transformed to knock out or knock down a polynucleotide encoding a protein that confers salt sensitivity. In some embodiments, the alga is a cyanobacteria species.

In some embodiments, the host alga transformed is a eukaryotic alga. In some embodiments, the host alga is a species of the Chlorophyta. In some embodiments, the alga is a microalga. In some instances, the microalga is a *Chlamydomonas* species. A transformed alga having salt tolerance by inactivation of a gene in the chloroplast genome is in some embodiments homoplastic for the inactivation.

In another embodiment, provided herein is a salt tolerant non-chlorophyll c-containing eukaryotic alga, comprising an exogenous polynucleotide integrated into the nuclear genome, wherein the exogenous polynucleotide comprises a sequence that encodes a protein that confers resistance to an herbicide, wherein resistance to the herbicide is conferred by a single exogenous protein.

In another embodiment, provided herein is a non-chlorophyll c-containing eukaryotic alga, comprising a knockout or a knockdown of a polynucleotide in the nuclear genome, wherein the absence or inhibition of the product of the polynucleotide confers resistance to salt.

Also provided herein is a salt tolerant non-chlorophyll c-containing eukaryotic alga, comprising a recombinant polynucleotide integrated into the nuclear genome, in which the recombinant polynucleotide encodes an endogenous or exogenous EPSPS protein that confers resistance to glyphosate.

Also provided are nucleic acid constructs for transforming algae with one or more nucleotide sequences that knock out or knock down genes in order to confer salt tolerance.

The disclosure further provides an alga comprising a recombinant polynucleotide that encodes a *Bacillus thuringiensis* (Bt) toxin protein. In one embodiment, the alga includes a cry gene encoding the Bt toxin. The exogenous Bt toxin gene can be incorporated in to the nuclear genome or the chloroplast genome of the alga. Introduction of a exogenous Bt toxin gene can interrupt and inactive nucleotides that encode a proteins conferring sensitivity to salt, thus making the alga salt tolerance.

The disclosure further provides a salt tolerant eukaryotic alga comprising one or more recombinant polynucleotide sequences encoding proteins that confer resistance to herbicides, in which each of the proteins confers resistance to a different herbicide. In one embodiment, at least one of the polynucleotide sequences encoding a protein conferring herbicide resistance is integrated into the chloroplast genome of a eukaryotic alga. In one embodiment, at least one of the polynucleotide sequences encoding a protein conferring herbicide resistance is integrated into the nuclear genome of a eukaryotic alga. In a further embodiment, at least a first of the two or more polynucleotide sequences encoding a protein conferring herbicide resistance is integrated into the chloroplast genome and at least a second of the two or more polynucleotide sequences encoding a protein conferring herbicide resistance is integrated into the nuclear genome of a eukaryotic alga.

Also provided herein is a non chlorophyll c-containing salt tolerant alga comprising a polynucleotide encoding a protein that confers resistance to an herbicide and an exogenous polynucleotide encoding a protein that does not confer resistance to an herbicide, wherein the protein that does not confer resistance to a herbicide is an industrial enzyme or therapeutic protein, or a protein that participates in or promotes the synthesis of at least one nutritional, therapeutic, commercial, or fuel product, or a protein that facilitates the isolation of at least one nutritional, therapeutic, commercial, or fuel product.

Also disclosed herein are methods of producing one or more biomolecules, in which the methods include transforming an alga by knocking out or knocking down one or more polynucleotides resulting in salt tolerance, growing the alga in the presence of high salt concentrations, and harvesting one or more biomolecules from the alga or algal media. The methods in some embodiments include isolating the one or more biomolecules.

In some embodiments, algae are further transformed with at least one herbicide resistance gene and at least one toxin gene, and are grown in the presence of at least one herbicide under conditions in which the toxin is expressed, and one or more biomolecules is harvested from the alga or algal media.

Also disclosed herein are methods of producing a biomass-degrading enzyme in an alga, in which the methods include: 1) transforming the alga by knocking out or knocking down one or more polynucleotides and so conferring salt tolerance to the alga, and a sequence encoding an exogenous biomass-degrading enzyme which promotes increased expression of an endogenous biomass-degrading enzyme; and 2) growing the alga in the presence of high salt concentrations and under conditions which allow for production of the biomass-degrading enzyme, in which the salt is in sufficient concentration to inhibit growth of the alga, which does not include the knock out or knock down conferring salt tolerance, to producing the biomass-degrading enzyme. The methods in some embodiments include isolating the biomass-degrading enzyme.

BRIEF DESCRIPTION OF THE DRAWINGS

These and other features, aspects, and advantages of the present disclosure will become better understood with regard to the following description, appended claims and accompanying figures where:

FIG. 7 shows the cre-MIR1157 nucleotide sequence (SEQ ID NO: 247) that was amplified from Chlamydomonas reinhardtii CC-1690 (mt+) genomic DNA via PCR. The location of the endogenous miRNA*-loop-miRNA sequences are indicated by "boxes."

The image label "S1623" refers to the Plate ID #S1623, strain number S1623, and Protein ID: 116145. See Table 1.

Figure 37:
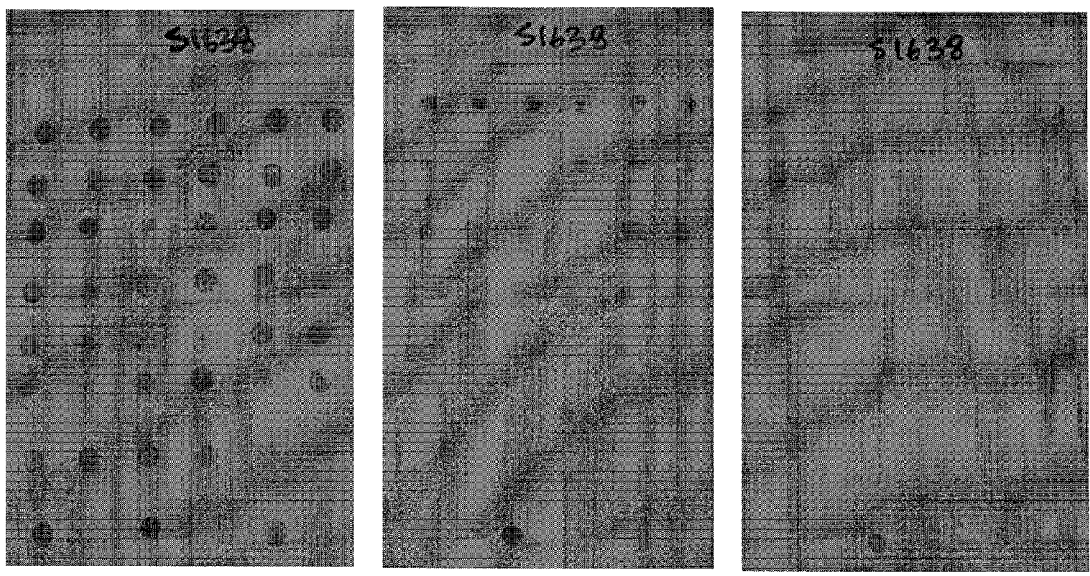

FIG. 37 shows 42 colonies for S1638 with controls at 75 mM, 100 mM, and 125 mM sodium chloride (left to right). The image label "S1638" refers to the Plate ID #31638, strain number S1638, and Protein ID: 418706. See Table 1.

Figure 38:
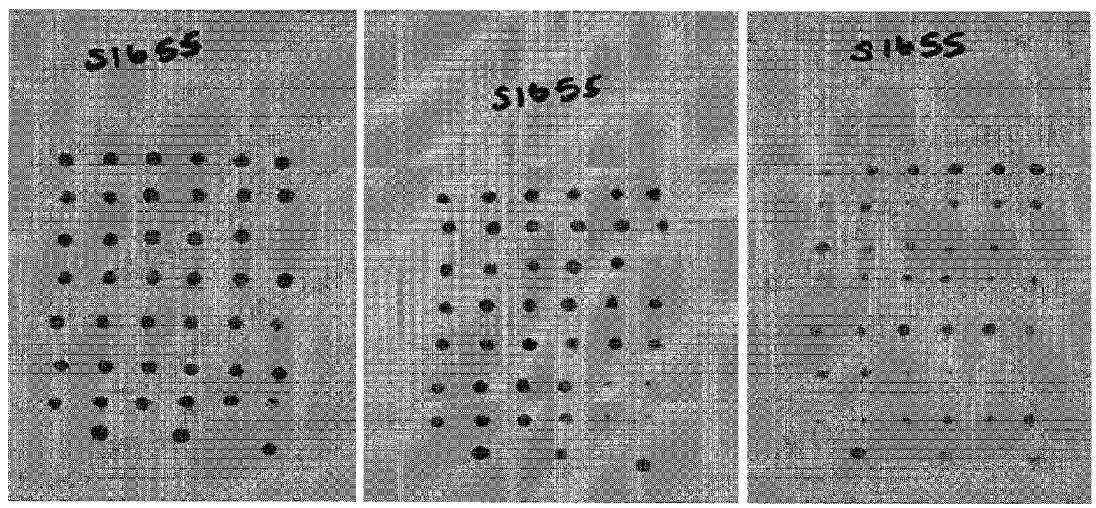

FIG. 38 shows 42 colonies for S1655 with controls at 75 mM, 100 mM, and 125 mM sodium chloride (left to right). The image label "S1655" refers to the Plate ID #S1655, strain number S1655, and Augustus v.5 Protein ID: 525078. See Table 1.

FIG. 39 shows S77 knockdown clones. The y axis is relative transcript abundance of the S77 gene and the x axis represents 6 individual clones (S77-1, S77-2, S77-3, S77-4, S77-5, and S77-6), wildtype *C. reinhardtii* (21gr), and the S77 gene disruption strain (S77 KO). The lower half of the figure shows the sensitivity to NaCl of the 6 individual knockdown clones, wild type *C. reinhardtii* (21gr), and the S77 gene disruption strain (left to right respectively). Decreased levels of transcript (strains S77-1, S77-2, and S77-3) correspond to increased NaCl resistance. Higher levels of transcript (strains S77-4, S77-5, and S77-6) correspond to increased NaCl sensitivity. Top row is 75 mM NaCl, middle row is 100 mM NaCl, and bottom row is 125 mM NaCl.

Figure 40:
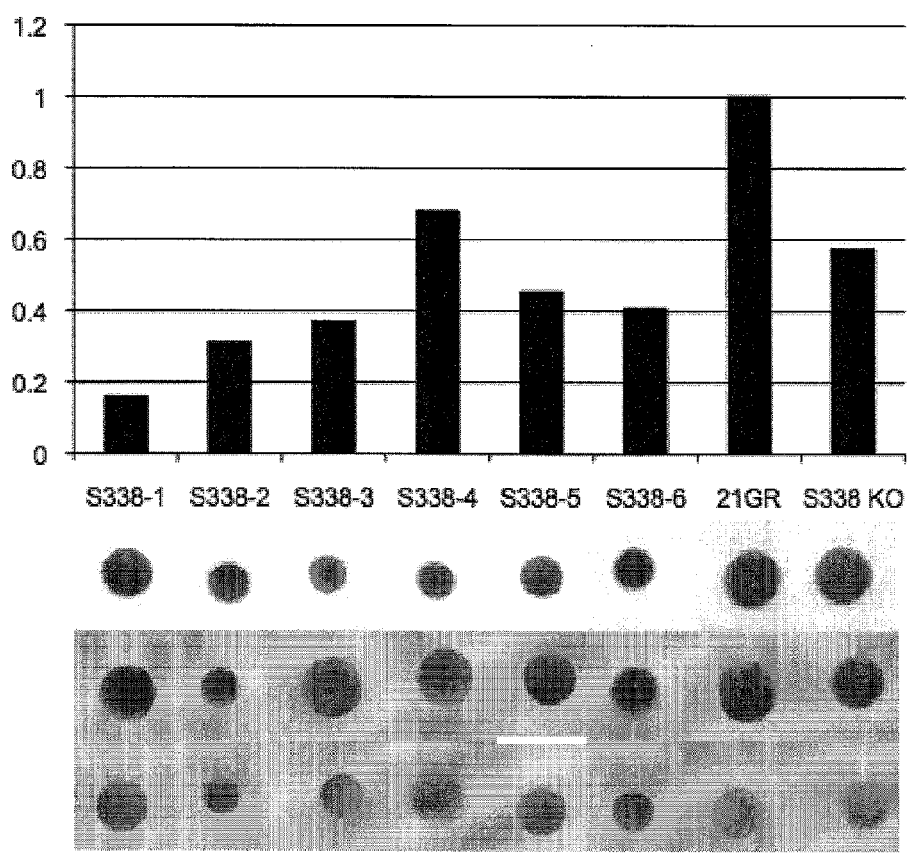

FIG. 40 shows S338 knockdown clones. The y axis is relative transcript abundance of the S338 gene and the x axis represents 6 individual clones (S338-1, S338-2, S338-3, S338-4, S338-5, and S338-6), wildtype *C. reinhardtii* (21 gr), and the S338 gene disruption strain (S338 KO). The lower half of the figure shows the sensitivity to NaCl of the 6 individual knockdown clones, wild type *C. reinhardtii* (21gr), and the S338 gene disruption strain (left to right respectively). Decreased levels of transcript (strains S338-1, S338-2, S338-3, S338-5, and S338-6) correspond to increased NaCl resistance. Top row is 75 mM NaCl, middle row is 100 mM NaCl, and bottom row is 125 mM NaCl.

Figure 41:
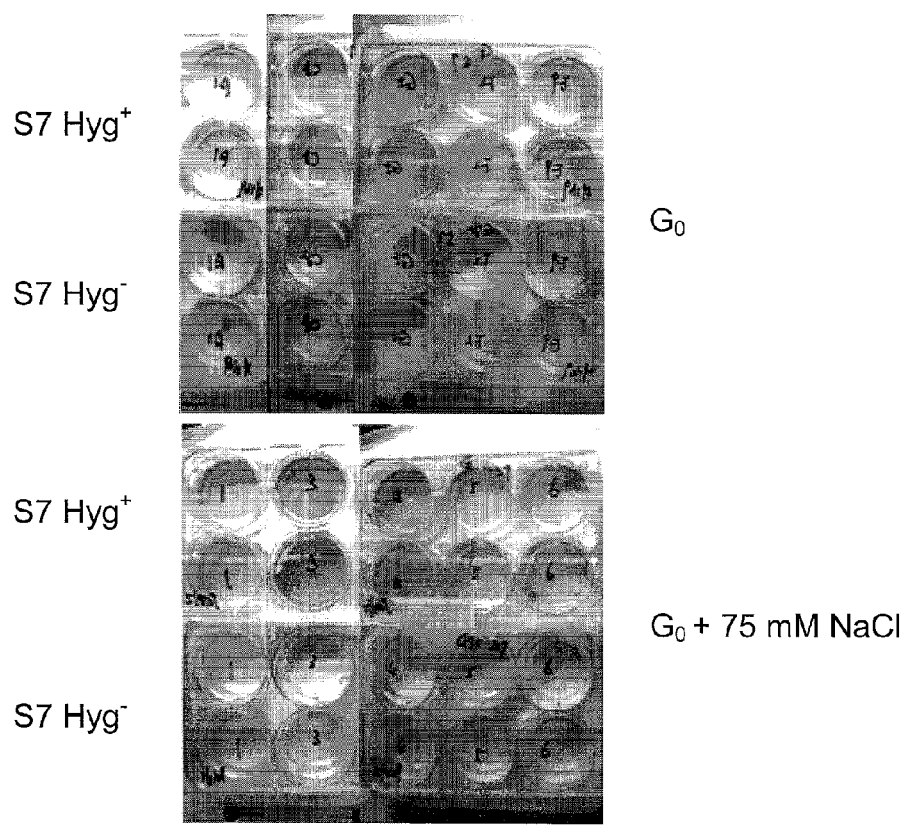

FIG. 41 shows the segregation analysis results for strain S7 of 5 strains resistant to hygromycin and 5 strains sensitive to hygromycin. The 5 strains resistant to hygromycin are also tolerant to liquid $G_0$ media+75 mM NaCl whereas the 5 strains sensitive to hygromycin do not grow in liquid $G_0$ media+75 mM NaCl. These results show that the phenotype (salt tolerance) is genetically linked to the antibiotic selection marker or gene disruption.

DETAILED DESCRIPTION

The following detailed description is provided to aid those skilled in the art in practicing the present disclosure. Even so, this detailed description should not be construed to unduly limit the present disclosure as modifications and variations in the embodiments discussed herein can be made by those of ordinary skill in the art without departing from the spirit or scope of the present disclosure.

As used in this specification and the appended claims, the singular forms "a", "an" and "the" include plural reference unless the context clearly dictates otherwise.

Endogenous

An endogenous nucleic acid, nucleotide, polypeptide, or protein as described herein is defined in relationship to the host organism. An endogenous nucleic acid, nucleotide, polypeptide, or protein is one that naturally occurs in the host organism.

Exogenous

An exogenous nucleic acid, nucleotide, polypeptide, or protein as described herein is defined in relationship to the host organism. An exogenous nucleic acid, nucleotide, polypeptide, or protein is one that does not naturally occur in the host organism or is a different location in the host organism.

Salt Tolerant

The relative growth of a non-vascular photosynthetic organism in the presence of salinity is termed its salt tolerance. Salt tolerance is the ability of a modified non-vascular photosynthetic organism to display an improved response to an increase in extracellular and/or intracellular concentration of salt including, but not limited to, Na+, Li+ and K+, as compared to an unmodified organism. Increased salt tolerance may be manifested by phenotypic characteristics including, for example, longer life span, increased growth rate, increase productivity, apparent normal growth and function of the plant, and/or a decreased level of necrosis, when subjected to an increase in salt concentration, as compared to an unmodified organism.

Salt tolerance can be measured by methods known to one of skill in the art, for example, methods as described in Inan et al. (July 2004) Plant Physiol. 135:1718, including without limitation, NaCl shock exposure or gradual increase of NaCl concentration.

Knockdown

Transcript levels are considered knocked down when an exogenous nucleic acid is transformed into a host organism to produce a RNA molecule (e.g. miRNA, siRNA) that results in RNA interference/silencing.

Knockout

A gene is considered knocked out when an exogenous nucleic acid is transformed into a host organism (e.g. by random insert-ion or homologous recombination) resulting in the disruption (e.g. by deletion, insertion) of the gene.

Nucleic Acid and Amino Acid Sequences

Sequence locations designations described below are from http://genome.jgi-psf.org/Chlre4/Chlre4.home.html (Merchant et al., *Science*, 318:245-250 (2007)).

SEQ ID NO: 1 Chromosome_6:1409923-1420881-523016

SEQ ID NO: 2 Chromosome_12:1410423-1416267-512725 Protein kinase, core

SEQ ID NO: 3 Chromosome_2:7302492-7305976-519629-Armadillo-type fold

SEQ ID NO: 4 Scaffold_23:64157-70065-520112

SEQ ID NO: 5 Chromosome_2:7871590-7907018-519707-Phosphatidylinositol 3- and 4-kinase, catalytic SEQ ID NO: 6 Chromosome_1:5106386-5121015-511373 and 511374-Calcium-binding EF-hand and Protein kinase, core

SEQ ID NO: 7 511374

SEQ ID NO: 8 Chromosome_17:5617386-5620810-517886 and 517887-Leucine-rich repeat

SEQ ID NO: 9 517887

SEQ ID NO: 10 Chromosome_6:6885194-6896388-524003

SEQ ID NO: 11 Chromosome_14:1451054-1454952-515336 and 515337-Calcium-binding EF-hand SEQ ID NO: 12 515337

SEQ ID NO: 13 74-chromosome_3:2741639-2747917-520845 and 520844-Protein kinase, core

SEQ ID NO: 14 520844

SEQ ID NO: 15 Chromosome_4:2134368-2137486-522165-Longin-like

SEQ ID NO: 16 Chromosome_10:3147531-3149275-510079-Zinc finger, RING-type

SEQ ID NO: 17 Chromosome_7:5889191-5892195-525104

SEQ ID NO: 18 Chromosome_16:1660154-1676212-516251

SEQ ID NO: 19 Chromosome_7:3216450-3222618-524679

SEQ ID NO: 20 Chromosome_2:8790481-8811695-519822-NSF attachment protein

SEQ ID NO: 21 Chromosome_10:2994349-2997683-510051

SEQ ID NO: 22 Chromosome_10:5445553-5448591-510417

SEQ ID NO: 23 Chromosome_3:1215915-1220466-Gene catalog-175772

SEQ ID NO: 24 Chromosome_10:1283278-1284432-509766 and 509765-Profilin/allergen

SEQ ID NO: 25 509765

SEQ ID NO: 26 Scaffold_22:53087-55615-520043

SEQ ID NO: 27 Chromosome_9:1628082-1634270-526026-Major facilitator superfamily

SEQ ID NO: 28 Chromosome_2:2611537-2615015-518848 and 518847-Thioredoxin-like and Alkyl hydroperoxide reductase/Thiol specific antioxidant/Mal allergen

SEQ ID NO: 29 518847

SEQ ID NO: 30 Chromosome_1:1574300-1583068-510801-Protein kinase, core

SEQ ID NO: 31 Chromosome_7:61977-65285-524187-Mitochondrial substrate carrier

SEQ ID NO: 32 Chromosome_12:7667470-7670704-513869

SEQ ID NO: 33 Chromosome_2:3580095-3582359-518990

SEQ ID NO: 34 Chromosome_3:6643095-6648853-521592 and 521593

SEQ ID NO: 35 521593

SEQ ID NO: 36 Chromosome_9:1237497-1242515-525958-GTP cyclohydrolase II

SEQ ID NO: 37 Chromosome_3:5568689-5570263-521411

SEQ ID NO: 38 Chromosome_16:282424-288402-516007 and 516008-Pumilio RNA-binding region

SEQ ID NO: 39 516008

SEQ ID NO: 40 Chromosome_4:1572817-1574661-522081

SEQ ID NO: 41 Chromosome_6:1447962-1450436-523024

SEQ ID NO: 42 Chromosome_16:1504475-1506533-516221-Cytochrome b5

SEQ ID NO: 43 Chromosome_1:2870207-2876411-510991 and 510992-Zinc finger, RING-type

SEQ ID NO: 44 510992

SEQ ID NO: 45 Chromosome_11:96916-101650-512152

SEQ ID NO: 46 Chromosome_10:2157223-2160721-509900

SEQ ID NO: 47 Chromosome_9:2397180-2401234-526112

SEQ ID NO: 48 Chromosome_12:5837-34345-512487-Dysferlin, N-terminal

SEQ ID NO: 49 Chromosome_5:3158380-3168988-522712

SEQ ID NO: 50 Chromosome_3:7372589-7375277-521690 and 521691

SEQ ID NO: 51 521691

SEQ ID NO: 52 Scaffold_18:812020-814034-518128 and 518129

SEQ ID NO: 53 518129

SEQ ID NO: 54 Chromosome_16:1333947-1337621-516191-NUDIX hydrolase, core

SEQ ID NO: 55 Chromosome_6:7046193-7049187-524030

SEQ ID NO: 56 Chromosome_5:2598236-2603160-522637

SEQ ID NO: 57 Chromosome_12:5998066-6000934-513600-ARF/SAR superfamily

SEQ ID NO: 58 Chromosome_12:6007846-6015554-513603 and 513602-ATPase, P-type, K/Mg/Cd/Cu/Zn/Na/Ca/Na/H-transporter

SEQ ID NO: 59 513602

SEQ ID NO: 60 Chromosome_5:599204-604348-522399-Protein kinase, core

SEQ ID NO: 61 Chromosome_11:1798315-1801943-512361-Plexin-like fold

SEQ ID NO: 62 Chromosome_1:1644920-1653379-510810 and 510811-Suppressor Mra1 and Protein kinase, core

SEQ ID NO: 63 510811

SEQ ID NO: 64 Chromosome_11:1635862-1641291-512347

SEQ ID NO: 65 Chromosome_3:1573144-1573807-520646-Prolyl 4-hydroxylase, alpha subunit SEQ ID NO: 66 Chromosome_16:1279888-1286957-516181

SEQ ID NO: 67 Chromosome_16:4386264-4397213-516652-Protease inhibitor I4, serpin SEQ ID NO: 68 Chromosome_1:3599000-3604849-511112-Nonaspanin (TM9SF)

SEQ ID NO: 69 Chromosome_13:2255306-2255882-514509

SEQ ID NO: 70 Chromosome_10:1448801-1450093-509796-Protein kinase, core

SEQ ID NO: 71 Chromosome_3:4748750-4749429-521248-ATPase, F1 complex, delta/epsilon subunit SEQ ID NO: 72 Chromosome_5:3179410-3179973-522714

SEQ ID NO: 73 Chromosome_3:4767136-4768060-521254-DNA/RNA helicase, C-terminal

SEQ ID NO: 74 Chromosome_1:3081958-3091707-511033

SEQ ID NO: 75 Chromosome_3:1280615-1281216-520594-Pyrrolo-quinoline quinine

SEQ ID NO: 76 Chromosome_10:6550769-6551325-510601

SEQ ID NO: 77 Chromosome_1:9020623-9021459-511987

SEQ ID NO: 78 Chromosome_6:1607759-1608312-523055-Adenylyl cyclase class-3/4/guanylyl cyclase SEQ ID NO: 79 Chromosome_13:3805266-3813325-514736

SEQ ID NO: 80 Chromosome_6:1189613-1199472-522979-14-3-3 protein

SEQ ID NO: 81 Scaffold_22:71878-72579-520045-AAA+ ATPase, core

SEQ ID NO: 82 Chromosome_10:5505341-5513220-510431-ATPase, P-type, K/Mg/Cd/Cu/Zn/Na/Ca/Na/H-transporter SEQ ID NO: 83 Chromosome_6:6387040-638749-523923

SEQ ID NO: 84 S7 transcript with UTRs.

SEQ ID NO: 85 S7 transcript without UTRs.

SEQ ID NO: 86 S7 protein sequence.

SEQ ID NO: 87 shows a 336 bp DNA fragment including the cre-MIR 1157 stem-loop from C. reinhardtii CC-1690 (mt+).

SEQ ID NO: 88 shows a PCR primer. See Table 3.

SEQ ID NO: 89 shows a PCR primer. See Table 3.

SEQ ID NO: 90 shows a PCR primer. See Table 3.
SEQ ID NO: 91 shows a PCR primer. See Table 3.
SEQ ID NO: 92 shows a PCR primer. See Table 3.
SEQ ID NO: 93 shows a PCR primer. See Table 3.
SEQ ID NO: 94 shows a PCR primer. See Table 3.
SEQ ID NO: 95 shows a PCR primer. See Table 3.
SEQ ID NO: 96 shows a PCR primer. See Table 3.
SEQ ID NO: 97 shows a PCR primer. See Table 3.
SEQ ID NO: 98 shows a PCR primer. See Table 3.
SEQ ID NO: 99 shows a PCR primer. See Table 3.
SEQ ID NO: 100 shows a PCR primer. See Table 3.
SEQ ID NO: 101 shows a PCR primer. See Table 3.
SEQ ID NO: 102 shows a PCR primer. See Table 3.
SEQ ID NO: 103 shows a PCR primer. See Table 3.
SEQ ID NO: 104 shows a PCR primer. See Table 3.
SEQ ID NO: 105 shows a PCR primer. See Table 3.
SEQ ID NO: 106 shows a PCR primer. See Table 3.
SEQ ID NO: 107 shows a PCR primer. See Table 3.
SEQ ID NO: 108 shows a PCR primer. See Table 3.
SEQ ID NO: 109 shows a PCR primer. See Table 3.
SEQ ID NO: 110 shows a PCR primer. See Table 3.
SEQ ID NO: 111 shows a PCR primer. See Table 3.
SEQ ID NO: 112 shows a PCR primer. See Table 3.
SEQ ID NO: 113 shows a PCR primer. See Table 3.
SEQ ID NO: 114 shows a PCR primer. See Table 3.
SEQ ID NO: 115 S7-Augustus v.5 ID: 523016
SEQ ID NO: 116 S16-Protein ID: 195781, Augustus v.5 ID: 512725
SEQ ID NO: 117 Protein ID: 103782, Augustus v.5 ID: 519629
SEQ ID NO: 118 Protein ID: 206633, Augustus v.5 ID: 520112
SEQ ID NO: 119 Protein ID: 174337, Augustus v.5 ID: 519707
SEQ ID NO: 120 Protein ID: 146649, Augustus v.5 ID: 511373
SEQ ID NO: 121 Augustus v.5 ID: 511374
SEQ ID NO: 122 S65-Protein ID: 410325, Augustus v.5 ID: 517886
SEQ ID NO: 123 Augustus v.5 ID: 517887
SEQ ID NO: 124 Protein ID: 144919, Augustus v.5 ID: 524003
SEQ ID NO: 125 Protein ID: 340425, Augustus v.5 ID: 515336
SEQ ID NO: 126 Protein ID: 381008, Augustus v.5 ID: 515337
SEQ ID NO: 127 S74-Augustus v.5 ID: 520845
SEQ ID NO: 128 Protein ID: 343410, Augustus v.5 ID: 520844
SEQ ID NO: 129 S77-Protein ID: 136188, Augustus v.5 ID: 522165
SEQ ID NO: 130 Augustus v.5 ID: 510079
SEQ ID NO: 131 Protein ID: 393353, Augustus v.5 ID: 525104
SEQ ID NO: 132 Protein ID: 176993, Augustus v.5 ID: 516251
SEQ ID NO: 133 S105-Protein ID: 24421, Augustus v.5 ID: 524679
SEQ ID NO: 134 S123-Protein ID: 151044, Augustus v.5 ID: 519822
SEQ ID NO: 135 S129-Protein ID: 182890, Augustus v.5 ID: 510051
SEQ ID NO: 136 Augustus v.5 ID: 510417
SEQ ID NO: 137 Protein ID: 175772
SEQ ID NO: 138 Protein ID: 186281, Augustus v.5 ID: 509766
SEQ ID NO: 139 Augustus v.5 ID: 509765
SEQ ID NO: 140 Augustus v.5 ID: 520043
SEQ ID NO: 141 Protein ID: 205891, Augustus v.5 ID: 526026
SEQ ID NO: 142 Protein ID: 141568, Augustus v.5 ID: 518848
SEQ ID NO: 143 Protein ID: 182094, Augustus v.5 ID: 518847
SEQ ID NO: 144 Protein ID: 406326, Augustus v.5 ID: 510801
SEQ ID NO: 145 Protein ID: 142644, Augustus v.5 ID: 524187
SEQ ID NO: 146 Protein ID: 173319, Augustus v.5 ID: 513869
SEQ ID NO: 147 Augustus v.5 ID: 518990
SEQ ID NO: 148 Augustus v.5 ID: 521592
SEQ ID NO: 149 Protein ID: 293419, Augustus v.5 ID: 521593
SEQ ID NO: 150 Protein ID: 163238, Augustus v.5 ID: 525958
SEQ ID NO: 151 Protein ID: 137074, Augustus v.5 ID: 521411
SEQ ID NO: 152 Protein ID: 396325, Augustus v.5 ID: 516007
SEQ ID NO: 153 Protein ID: 35759, Augustus v.5 ID: 516008
SEQ ID NO: 154 Protein ID: 183391, Augustus v.5 ID: 522081
SEQ ID NO: 155 Protein ID: 182345, Augustus v.5 ID: 523024
SEQ ID NO: 156 Protein ID: 131692, Augustus v.5 ID: 516221
SEQ ID NO: 157 Protein ID: 146316, Augustus v.5 ID: 510991
SEQ ID NO: 158 Protein ID: 404865, Augustus v.5 ID: 510992
SEQ ID NO: 159 Protein ID: 394374, Augustus v.5 ID: 512152
SEQ ID NO: 160 Protein ID: 421582, Augustus v.5 ID: 509900
SEQ ID NO: 161 Protein ID: 184523, Augustus v.5 ID: 526112
SEQ ID NO: 162 S276-Augustus v.5 ID: 512487
SEQ ID NO: 163 Protein ID: 522712
SEQ ID NO: 164 Augustus v.5 ID: 521690
SEQ ID NO: 165 Augustus v.5 ID: 521691
SEQ ID NO: 166 S289-Protein ID: 411672, Augustus v.5 ID: 518128
SEQ ID NO: 167 Protein ID: 185219, Augustus v.5 ID: 518129
SEQ ID NO: 168 S291-Protein ID: 395916, Augustus v.5 ID: 516191
SEQ ID NO: 169 S292-Protein ID: 188858, Augustus v.5 ID: 524030
SEQ ID NO: 170 S294-Protein ID: 187373, Augustus v.5 ID: 522637
SEQ ID NO: 171 S303-Protein ID: 190294, Augustus v.5 ID: 513600
SEQ ID NO: 172 Augustus v.5 ID: 513603
SEQ ID NO: 173 Protein ID: 190292, Augustus v.5 ID: 513602
SEQ ID NO: 174 Protein ID: 132979, Augustus v.5 ID: 522399
SEQ ID NO: 175 S338-Protein ID: 151163, Augustus v.5 ID: 512361
SEQ ID NO: 176 Protein ID: 178371, Augustus v.5 ID: 510810

SEQ ID NO: 177 Protein ID: 193901, Augustus v.5 ID: 510811

SEQ ID NO: 178 Protein ID: 151147, Augustus v.5 ID: 512347

SEQ ID NO: 179 Protein ID: 417522, Augustus v.5 ID: 520646

SEQ ID NO: 180 Protein ID: 195665, Augustus v.5 ID: 516181

SEQ ID NO: 181 Protein ID: 288478, Augustus v.5 ID: 516652

SEQ ID NO: 182 Protein ID: 136718, Augustus v.5 ID: 511112

SEQ ID NO: 183 Augustus v.5 ID: 514509

SEQ ID NO: 184 Protein ID: 206095, Augustus v.5 ID: 509796

SEQ ID NO: 185 Protein ID: 136002, Augustus v.5 ID: 521248

SEQ ID NO: 186 Protein ID: 294540, Augustus v.5 ID: 522714

SEQ ID NO: 187 Protein ID: 136100, Augustus v.5 ID: 521254

SEQ ID NO: 188 Protein ID: 342157, Augustus v.5 ID: 511033

SEQ ID NO: 189 Protein ID: 206488, Augustus v.5 ID: 520594

SEQ ID NO: 190 Protein ID: 205974, Augustus v.5 ID: 510601

SEQ ID NO: 191 Protein ID: 130473, Augustus v.5 ID: 511987

SEQ ID NO: 192 Augustus v.5 ID: 523055

SEQ ID NO: 193 Protein ID: 331285, Augustus v.5 ID: 514736

SEQ ID NO: 194 Protein ID: 187228, Augustus v.5 ID: 522979

SEQ ID NO: 195 Protein ID: 132213, Augustus v.5 ID: 520045

SEQ ID NO: 196 Protein ID: 182602, Augustus v.5 ID: 510431

SEQ ID NO: 197 Augustus v.5 ID: 523923

SEQ ID NO: 198 S1612-Protein ID: 103075, Augustus v.5 ID: 513845

SEQ ID NO: 199 S1625-Protein ID: 186846

SEQ ID NO: 200 S1644-Protein ID: 331285, Augustus v.5 ID: 514736

SEQ ID NO: 201 S1659-Protein ID: 178706

SEQ ID NO: 202 S1666-Augustus v.5 ID: 514721

SEQ ID NO: 203 S1687-Protein ID: 291633

SEQ ID NO: 204 S1693-Protein ID: 188114

SEQ ID NO: 205 S1702-Protein ID: 536097

SEQ ID NO: 206 S1704-Protein ID: 77062

SEQ ID NO: 2117 S7 amiRNA cloning fragment

SEQ ID NO: 218 S16 amiRNA cloning fragment

SEQ ID NO: 219 S65 amiRNA cloning fragment

SEQ ID NO: 210 S77 amiRNA cloning fragment

SEQ ID NO: 211 S105 amiRNA cloning fragment

SEQ ID NO: 212 S123 amiRNA cloning fragment

SEQ ID NO: 213 S129 amiRNA cloning fragment

SEQ ID NO: 214 S276 amiRNA cloning fragment

SEQ ID NO: 215 S289 amiRNA cloning fragment

SEQ ID NO: 216 S291 amiRNA cloning fragment

SEQ ID NO: 217 S292 amiRNA cloning fragment

SEQ ID NO: 218 S294 amiRNA cloning fragment

SEQ ID NO: 219 S303 amiRNA cloning fragment

SEQ ID NO: 220 S338 amiRNA cloning fragment

SEQ ID NO: 221 S1612 amiRNA cloning fragment

SEQ ID NO: 222 S1644 amiRNA cloning fragment

SEQ ID NO: 223 S1659 amiRNA cloning fragment

SEQ ID NO: 224 S1666 amiRNA cloning fragment

SEQ ID NO: 225 S1687 amiRNA cloning fragment

SEQ ID NO: 226 S1693 amiRNA cloning fragment

SEQ ID NO: 227 S1704 amiRNA cloning fragment

SEQ ID NO: 228 BD11 sequence

SEQ ID NO: 229 BD11 3' primer to generate double stranded amiRNA cloning fragment.

SEQ ID NO: 230 S1613-Protein ID: 174261, Augustus v.5 ID: 519617

SEQ ID NO: 231 S1621-Protein ID: 206559

SEQ ID NO: 232 S1623-Protein ID: 116145, Augustus v.5 ID: 511331

SEQ ID NO: 233 S1638-Protein ID: 418706, Augustus v.5 ID: 521355

SEQ ID NO: 234 S1655-Augustus v.5 ID: 525078

SEQ ID NO: 235 S74 amiRNA cloning fragment

SEQ ID NO: 236 S1613 amiRNA cloning fragment

SEQ ID NO: 237 S1621 amiRNA cloning fragment

SEQ ID NO: 238 S1623 amiRNA cloning fragment

SEQ ID NO: 239 S1638 amiRNA cloning fragment

SEQ ID NO: 240 S1655 amiRNA cloning fragment

SEQ ID NO: 241 shows a PCR primer. See Table 3.

SEQ ID NO: 242 shows a PCR primer. See Table 3.

SEQ ID NO: 243 shows a PCR primer. See Table 3.

SEQ ID NO: 244 shows a PCR primer. See Table 3.

SEQ ID NO: 245 shows a PCR primer. See Table 3.

SEQ ID NO: 246 shows a PCR primer. See Table 3.

TABLE 1

| Sequence Listing Number | Protein ID Number | Strain Number | Plate ID# |
|---|---|---|---|
| SEQ ID NO: 115 | 523016 (aug5) | S7 | S7 |
| SEQ ID NO: 116 | 195781 | S16 | S16 |
| SEQ ID NO: 122 | 517886 (aug5) | S65 | S65 |
| SEQ ID NO: 201 | 178706 | S1659 | S59 |
| SEQ ID NO: 129 | 522165 (aug5) | S77 | S77 |
| SEQ ID NO: 202 | 514721 (aug5) | S1666 | S66 |
| SEQ ID NO: 206 | 77062 | S1704 | S109 |
| SEQ ID NO: 133 | 524679 (aug5) | S105 | S105 |
| SEQ ID NO: 198 | 103075 | S1612 | S12 |
| SEQ ID NO: 200 | 331285 | S1644 | S44 |
| SEQ ID NO: 204 | 188114 | S1693 | S120 |
| SEQ ID NO: 203 | 291633 | S1687 | S114 |
| SEQ ID NO: 135 | 510051 (aug5) | S129 | S129 |
| SEQ ID NO: 134 | 519822 (aug5) | S123 | S123 |
| SEQ ID NO: 166 | 518128 (aug5) | S289 | S289 |
| SEQ ID NO: 162 | 512487(aug5) | S276 | S276 |
| SEQ ID NO: 169 | 524030 (aug5) | S292 | S292 |
| SEQ ID NO: 168 | 516191 (aug5) | S291 | S291 |
| SEQ ID NO: 170 | 522637 (aug5) | S294 | S294 |
| SEQ ID NO: 175 | 512361 (aug5) | S338 | S338 |
| SEQ ID NO: 127 | 520845 (aug5) | S74 | S74 |
| SEQ ID NO: 230 | 174261 | S1613 | S1613 |
| SEQ ID NO: 231 | 206559 | S1621 | S1621 |
| SEQ ID NO: 232 | 116145 | S1623 | S1623 |
| SEQ ID NO: 233 | 418706 | S1638 | S1638 |
| SEQ ID NO: 234 | 525078 (aug5) | S1655 | S1655 |

*aug5 refers to the Augustus v.5 Protein ID database. These are used because the standard annotation of the *C. reinhardtii* genome does not include those genes. Augustus v.5 is generated by a gene prediction algorithm.

RNA Silencing

*Chlamydomonas reinhardtii* is a single-celled green alga that is an ideal model system for studying several biological processes. Its recently sequenced genome has advanced our understanding of the ancestral eukaryotic cell and revealed many previously unknown genes that may be associated with photosynthetic and flagellar functions (for example, as described in Merchant. S. S., et al. (2007) *Science*, 318, 245-250). Analysis of this genome requires a convenient system for reverse genetic analysis.

Transposon tagging, insertional nmutagenesis and tilling have been highly successful reverse genetics tools in flowering plants (for example, as described in Alonso, J. M. and Ecker, J. R. (2006) *Natl. Rev. Genet.*, 7, 524-536), but have not yet been fully developed in *Chlamydomonas*. Saturating entire genomes by these approaches requires very large mutant populations and can be limited by the selectivity of mutational targeting. Alternative methods for high-throughput analysis of gene function are based on RNA silencing. They exploit a conserved cellular mechanism that probably evolved as a defense strategy against viruses and transposons and that has been adopted for endogenous gene regulation in many eukaryotes (for example, as described in Baulcombe, D. (2006) Short Silencing RNA: The Dark Matter of Geneics? Cold Spring Harb. Symp. Quant. Biol., LXXI, 13-20). Small RNAs (21-24 nucleotides (nt)) are central components in this process, providing sequence specificity for the effector complexes of the silencing machinery.

There are two main classes of small RNAs in RNA silencing: small interfering RNAs (siRNAs) and microRNAs (miRNAs). The siRNAs are produced from a perfectly double-stranded (ds) RNA by RNaseIII-like enzymes (Dicer or Dicer-like), releasing several double-stranded intermediates of about 21 nt in length, with a two-nucleotide 3'overhang (for example, as described in Elbashir, S. M., et al. (2001) *Genes Dev.*, 15, 188-200). In contrast, miRNA intermediates are released by Dicer as a 21-24-nt RNA duplex from a partly double-stranded region of an imperfectly matched foldback RNA (for example, as described in Ambros, V. (2001) *Cell*, 107, 823-826). Each miRNA precursor typically gives rise to one predominant 21-24-nt RNA duplex whereas multiple forms of this molecule are generated from siRNA precursors.

The short dsRNAs are processed similarly in both miRNA and siRNA pathways. The strands with lower thermodynamic stability at their 5' ends are stably retained by an Argonaute (AGO) protein (for example, as described in Khvorova, A., et al. (2003) *Cell*, 115, 209-216; and Schwarz, D. S., et al. (2003) *Cell*, 115, 199-208) through a mechanism that is influenced by the 5' nucleotide (for example, as described in Mi, S., et al. (2008) *Cell*, 133, 116-127). The resulting AGO ribonucleoprotein is the effector of silencing that is guided to its target nucleic acids through Watson-Crick base pairing with the bound small RNA. The small RNA strand that is not incorporated into the Argonaute is referred to as the passenger strand or miRNA* and is rapidly degraded.

The targeting mechanisms involve transcriptional or post-transcriptional regulation of the target sequence. The transcriptional silencing mechanism is not well understood and it has not been used in methods for functional analysis of genome sequences. The post-transcriptional mechanisms, in contrast, are better understood in detail and have been used widely. They involve translational arrest or targeted RNA degradation, either by mRNA destabilization or miRNA guided cleavage (for example, as described in Bartel, D. P. (2004) *Cell*, 116, 281-297); small RNAs displaying partial complementarity to the target RNA typically cause translational inhibition whereas those with a complete or near-complete match are more likely to direct mRNA cleavage. The miRNAs in animals are often complementary to their target in a short seed region (positions 2 to 8) allowing each miRNA to target many, often hundreds, of mRNAs (for example, as described in Brennecke, J., et al. (2005) PloS Biology, 3, e85; Farh, K. K., et al. (2005) *Science*, 310, 1817-1821; Lewis, B. P., et al. (2005) *Cell*, 120, 15-20; and Lim, L. P., et al. (2005) *Nature*, 433, 769-773). In contrast, plant miRNAs have few (zero to five) mismatches to their targets and normally trigger transcript cleavage and subsequent degradation of a limited number of mRNAs (for example, as described in Llave, C., et al. (2002) *Science*, 297, 2053-2056; and Schwab, R., et al. (2005) *Developmental Cell*, 8, 517-527).

An alternative to the use of long dsRNA transgenes to down-regulate a gene of interest involves modified versions of endogenous miRNA (for example, as described in Zeng, Y., et al. (2002) *Molecular Cell*, 9, 1327-1333; Parizotto, E. A., et al. (2004) *Genes Dev.*, 18, 1-6; Alvarez, J. P., et al. (2006) *The Plant Cell*, 18, 1134-1151; Niu, Q. W., et al. (2006) *Natl. Biotechnol.*, 24, 1420-1428; Schwab, R., et al. (2006) *The Plant Cell*, 18, 1121-1133; and Warthmann, N., et al. (2008) *PloS ONE*, 3, e1829). This artificial miRNA approach overcomes the self-silencing problems of siRNAs because miRNAs are not normally associated with transcriptional silencing. In addition, each artificial miRNA precursor gives rise to only a single small RNA species that can be optimized to avoid off-target effects, at least in the case of organisms with complete genome information.

*Chlamydomonas* miRNA loci can be subdivided into two categories. Those in the 'short hairpin' category resemble typical miRNA loci of land plants and animals in that the hairpin regions are shorter than 150 nt and they specify a single miRNA. The predicted transcripts of 'long hairpin' loci in *Chlamydomonas* can form long (150-729 nt) almost perfect hairpins, with the potential to produce multiple small RNAs (for example, as described in Molnar, A., et al. (2007) *Nature*, 447, 1126-1129; and Zhao, T., et al. (2007) *Genes Dev.*, 21, 1190-1203).

Artificial miRNAs (amiRNAs) can be used as a highly specific, high-throughput silencing system to verify a desired phenotype (for example, a salt, herbicide, or bleach resistance organism) that is the result of the expression of a candidate gene.

The present disclosure recognizes that large scale cultures of algae can be used to produce a variety of biomolecules. The disclosed methods, constructs, algae, and cells are provided to fully realize the advantages of algal cultures for large-scale production of useful biomolecules as well as for other purposes, such as, for example, carbon fixation or decontamination of compounds, solutions, or mixtures. The present disclosure also recognizes the potential for algae, through photosynthetic carbon fixation, to convert $CO_2$ to sugar, starch, lipids, fats, or other biomolecules, thereby removing a greenhouse gas from the atmosphere while providing therapeutic or industrial products, a fuel product, or nutrients for human or animal consumption. To enable large scale growth of algal cultures in open ponds or large containers in which they efficiently and economically have access to $CO_2$ and light, it is important to deter the growth of competing organisms that might otherwise contaminate and even overtake the culture. Provided herein are algae in which genes have been knocked out or knocked down to confer salt tolerance, such that the algae are able to grow in the presence of salt at a concentration that deters growth of algae not harboring the knock out or knock down gene. The concentration of salt may also deter the growth of other organisms, such as, but not necessarily limited to, other algal species.

Plant species, which includes algae, vary in how well they tolerate salt. Some plants will tolerate high levels of salinity while others can tolerate little or no salinity. The relative growth of plants in the presence of salinity is termed their salt tolerance. Salt tolerance is the ability of a modified plant or plant cell (also host cell or organism) to display an improved response to an increase in extracellular and/or intracellular concentration of salt including, but not limited to, Na+, Li+ and K+, as compared to an unmodified plant or plant cell. Increased salt tolerance may be manifested by phenotypic characteristics including longer life span, apparent normal growth and function of the plant, and/or a decreased level of necrosis, when subjected to an increase in salt concentration, as compared to a unmodified plant. Salt tolerance is measured by methods known in the art such as those described in Inan et al. (July 2004) Plant Physiol. 135:1718, including without limitation, NaCl shock exposure or gradual increase NaCl concentration.

A transgenic algal cell of the present disclosure has increased salt tolerance with respect to a wild type algal cell that does not contain the knock out or knock down gene. In some embodiments, the salt tolerance is at least twice that of a wildtype alga. The salt tolerance can be at least 1.5, 2, 2.5, 3, 3.5, 4, 5 or more than 5 fold higher than that of a wildtype alga.

The salt used in the present disclosure can be a sodium (Na+) salt, a lithium (Li+) salt, or a potassium (K+) salt. The concentration of Na+ in the selection media for the transgenic algae of the present disclosure can be at least 200 mM. The concentration of Li+ in the selection media for the transgenic algae of the present disclosure can be at least 2 mM, Algae The present disclosure provides algae and algal cells in which one or more polynucleotides have been knocked out to confer salt tolerance. Also provided are algae and algal cells transformed with a polynucleotide encoding the Bt toxin that is lethal to some insect and rotifer species. The transformed algae may be referred to herein as "host algae".

Algae in which genes have been knocked out to provide salt tolerance as disclosed herein can be macroalgae or microalgae. Microalgae include eukaryotic microalgae and cyanobacteria.

An exemplary group of organisms for use in the present disclosure are species of the green algae (Chlorophyta). These algae are found in soil, fresh water, oceans, and even in snow on mountaintops. Algae in this genus have a cell wall, a chloroplast, and two anterior flagella allowing mobility in liquid environments. More than 500 different species of *Chlamydomonas* have been described.

The most widely used laboratory species is *C. reinhardtii*. When deprived of nitrogen, *C. reinhardtii* cells can differentiate into isogametes. Two distinct mating types, designated mt+ and mt−, exist. These fuse sexually, thereby generating a thick-walled zygote which forms a hard outer wall that protects it from various environmental conditions. When restored to nitrogen culture medium in the presence of light and water, the diploid zygospore undergoes meiosis and releases four haploid cells that resume the vegetative life cycle. In mitotic growth the cells double as fast as every eight hours.

The nuclear genetics of *C. reinhardtii* is well established. There are a large number of mutants that have been characterized and the *C. reinhardtii* center (www.chlamy.org) maintains an extensive collection of mutants, as well as annotated genomic sequences of *Chlamydomonas* species. A large number of chloroplast mutants as well as several mitochondrial mutants have been developed in *C. reinhardtii*.

While the methods and transformed cells are described herein with *C. reinhardtii* in some exemplary aspects, it is understood that the methods and transformants described herein are also applicable to other algae, including cyanobacteria such as but not limited to *Synechococcus, Synechocystis, Athrospira, Anacytis, Anabaena, Nostoc, Spirulina*, and *Fremyella* species and including green microalgae such as but not limited to *Dunaliella, Scenedesmus, Chlorella, Volvox*, or *Hematococcus* species.

Transformed cells are produced by introducing DNA into a population of target cells and selecting the cells which have taken up the DNA. In some embodiments, knock outs or knock downs that confer resistance to salt may be grown in the presence of high salt concentrations to select for successful knock outs or knock downs. The knock out or knock down sequence can be introduced into an algal cell using a direct gene transfer method such as, for example, electroporation, microprojectile mediated (biolistic) transformation using a particle gun, the "glass bead method" or by cationic lipid or liposome-mediated transformation.

Nuclear transformation of eukaryotic algal cells can be by microprojectile mediated transformation, or can be by protoplast transformation, electroporation, introduction of DNA using glass fibers, or the glass bead agitation method, as nonlimiting examples (Kindle. *Proc. Natl. Acad. Sciences USA* 87: 1228-1232 (1990); Shimogawara et al. *Genetics* 148: 1821-1828 (1998)). Markers for nuclear transformation of algae include, without limitation, markers for rescuing auxotrophic strains (e.g., NIT1 and ARG7 in *Chlamydomonas*; Kindle et al. *J. Cell Biol.* 109: 2589-2601 (1989), Debuchy et al. *EMBO J.* 8: 2803-2809 (1989)), as well as dominant selectable markers (e.g., CRY1, aada; Nelson et al. *Mol. Cellular Biol.* 14: 4011-4019 (1994), Cerutti et al. *Genetics* 145: 97-110 (1997)). In some embodiments, the presence of the knock out or knock down is used as a selectable marker for transformants. A knock out sequence can in some embodiments be co-transformed with a second sequence encoding a protein to be produced by the alga (for example, a therapeutic protein, industrial enzyme) or a protein that promotes or enhances production of a commercial, therapeutic, or nutritional product. The second sequence is in some embodiments provided on the same nucleic acid construct as the knock out sequence for transformation into the alga, in which the success of the knock out sequence in activating the gene of interest is used as the selectable marker.

Several cell division cycles following transformation are generally required to reach a homoplastidic state. Algae may be allowed to divide in the presence or absence of a selection agent, or under stepped-up selection (use of a lower concentration of the selective agent than homoplastic cells would be expected to grow on, which can be increased over time) prior to screening transformants. Screening of transformants by PCR or Southern hybridization, for example, can be performed to determine whether a transformant is homoplastic or heteroplastic, and if heteroplastic, the degree to which the recombinant gene has integrated into copies of the chloroplast genome.

For transformation of chloroplasts, a major benefit can be the utilization of a recombinant nucleic acid construct which contains both the knock out sequence and one or more genes of interest. Typically, transformation of chloroplasts is performed by co-transformation of chloroplasts with two constructs: one containing knock out sequence and a second containing the gene(s) of interest. Transformants are screened for presence of the knock out or knock down (salt tolerance) and, in some embodiments, for the presence of (a) further gene(s) of interest. Typically, secondary screening for one or more gene(s) of interest is performed by PCR or Southern blot (see, for example PCT/US2007/072465).

The organisms/host cells herein can be transformed to modify the production of a product(s) with a vector, in this case to decrease or eliminate production of a product(s). The vector is typically substantially homologous to the gene to be knocked out to allow for homologous recombination to take place, but has been modified in such a way that the product normally produced by the gene is not produced, is produced in an inactive form, or is produced in a form in which the normal activity of the product is greatly reduced.

One approach to construction of a genetically manipulated strain of alga involves transformation with a nucleic acid which inactivates a gene of interest to, for example, confer resistance to salt. In some embodiments, a transformation may introduce nucleic acids into the host alga cell (for example, a chloroplast or nucleus of a eukaryotic host cell). Transformed cells are typically plated on selective media following introduction of exogenous nucleic acids. This method may also comprise several steps for screening. Initially, a screen of primary transformants is typically conducted to determine which clones have proper insertion of the exogenous nucleic acids. Clones which show the proper integration may be replica plated and re-screened to ensure genetic stability. Such methodology ensures that the genes of interest have been knocked out or knocked down. In many instances, such screening is performed by polymerase chain reaction (PCR); however, any other appropriate technique known in the art may be utilized, Many different methods of PCR are known in the art (for example, nested PCR, real time PCR).

The entire chloroplast genome of *C. reinhardtii* is available as GenBank Acc. No. BK000554 and reviewed in J. Maul, et al. The Plant Cell 14: 2659-2679 (2002), both incorporated by reference herein. The *Chlamydomonas* genome is also provided to the public on the world wide web, at the URL "biology.duke.edu/chlamy_genome/-chloro.html" (see "view complete genome as text file" link and "maps of the chloroplast genome" link), each of which is incorporated herein by reference. To create a knock out, the nucleotide sequence of the chloroplast genomic DNA is selected such that it is a portion of a gene of interest, including a regulatory sequence or coding sequence. In this respect, the website containing the *C. reinhardtii* chloroplast genome sequence also provides maps showing coding and non-coding regions of the chloroplast genome, thus facilitating selection of a sequence useful for constructing a knock out vector.

A knock out nucleic acid molecule may include a nucleotide sequence encoding a reporter polypeptide or other selectable marker. The term "reporter" or "selectable marker" refers to a polynucleotide (or encoded polypeptide) that confers a detectable phenotype. A reporter generally encodes a detectable polypeptide, for example, a green fluorescent protein or an enzyme such as luciferase, which, when contacted with an appropriate agent (a particular wavelength of light or luciferin, respectively) generates a signal that can be detected by eye or using appropriate instrumentation (Giacomin, *Plant Sci.* 116:59-72, 1996; Scikantha, *J. Bacteriol.* 178:121, 1996; Gerdes, *FEBS Lett.* 389:44-47, 1996; see, also, Jefferson, *EMBO J.* 6:3901-3907, 1997, fl-glucuronidase).

A selectable marker can provide a means to rapidly screen prokaryotic cells or plant cells or both that have incorporated the knock out sequence and so express the marker. Examples of selectable markers include, but are not limited to, those that confer antimetabolite resistance, for example, dihydrofolate reductase, which confers resistance to methotrexate (Reiss, *Plant Physiol. (Life Sci. Adv.)* 13:143-149, 1994); neomycin phosphotransferase, which confers resistance to the aminoglycosides neomycin, kanamycin and paromycin (Herrera-Estrella, *EMBO J.* 2:987-995, 1983), hygro, which confers resistance to hygromycin (Marsh, *Gene* 32:481-485, 1984), trpB, which allows cells to utilize indole in place of tryptophan; hisD, which allows cells to utilize histinol in place of histidine (Hartman, *Proc. Natl. Acad. Sci., USA* 85:8047, 1988); mannose-6-phosphate isomerase which allows cells to utilize mannose (WO 94/20627); ornithine decarboxylase, which confers resistance to the ornithine decarboxylase inhibitor, 2-(difluoromethyl)-DL-ornithine (DFMO; McConlogue, 1987, in: Current Communications in Molecular Biology, Cold Spring Harbor Laboratory ed.); and deaminase from *Aspergillus terreus*, which confers resistance to Blasticidin S (Tamura, *Biosci. Biotechnol Biochem.* 59:2336-2338, 1995). Selectable markers include polynucleotides that confer dihydrofolate reductase (DHFR) or neomycin resistance for eukaryotic cells and tetracycline; ampicillin resistance for prokaryotes such as *E. coli*; and bleomycin, gentamycin, glyphosate, hygromycin, kanamycin, methotrexate, phleomycin, phosphinotricin, spectinomycin, streptomycin, sulfonamide and sulfonylurea resistance in plants (see, for example, Maliga et al., Methods in Plant Molecular Biology, Cold Spring Harbor Laboratory Press, 1995, page 39).

Salt tolerance can also be a selectable marker. The host algae disclosed herein that are transformed with polynucleotides knocking out or knocking down one or more genes in order to confer resistance to salt may be selected for with elevated salt concentrations. Alternatively, a selectable marker such as kanamycin or bleomycin or nitrate reductase may be co-transformed with the knock out sequence, and transformed cells can initially be selected for using a selection media or compound that is not related to the knocked out gene.

Large scale cultures of algae bioengineered for salt tolerance can be used for the production of biomolecules, which can be therapeutic, nutritional, commercial, or fuel products, or for fixation of $CO_2$, or for decontamination of compounds, mixtures, samples, or solutions. The salt tolerant algae provided herein can be grown in a concentration of salt that can impede or prevent the growth of species other than the algal species used for bioproduction, decontamination, or $CO_2$ fixation. In certain embodiments the concentration of salt is 1.5, 2, 2.5, 3, 3.5, 4, 4.5, 5 or greater than 5 times tolerated by the corresponding wild type alga. In other embodiments the average concentration of $Na^{2+}$ is 200 mM or more. In still other embodiments the concentration of $Li^+$ in the medium is about 2 mM or more. In certain embodiments of the disclosure, a host alga engineered to provide salt tolerance is transformed with one or more additional genes that encodes an exogenous or endogenous protein that is produced by the alga when it is grown in culture, in which the exogenous or endogenous protein is a therapeutic, nutritional, commercial, or fuel product, or increases production or facilitates isolation of a therapeutic, nutritional, commercial, or fuel product.

A salt resistant alga as provided herein may be used in some embodiments to produce biomolecules that are endogenous or not endogenous to the algal host. In some embodiments, the genetically engineered salt tolerant algae can be cultured for environmental remediation or $CO_2$ fixation. The algae may additionally be transformed with one or more recombinant exogenous or endogenous polynucleotides that enable growth of the algae in the presence of at least one herbicide. Genetic engineering of algae to confer resistance to herbicides has been described in U.S. patent application 61/142,091 filed Dec. 31, 2008, which in incorporated reference in its entirety.

In some embodiments, a prokaryotic alga provided herein is resistant to one or more herbicides in addition to being salt tolerant. A prokaryotic alga can include a first recombinant exogenous or endogenous herbicide resistance gene conferring resistance to a first herbicide and a second exogenous or endogenous herbicide resistance gene conferring resistance to a second herbicide.

The polynucleotide encoding the herbicide resistance gene can be provided in a vector for transformation of the algal host. In some embodiments, the vector is designed for integration into the host genome, and can include, for example, sequences having homology to the host genome flanking the herbicide resistance gene to promote homologous recombination. In other embodiments, the vector can have an origin of replication such that it can be maintained in the host as an autonomously replicating episome. In some embodiments, the protein-encoding sequence of the polynucleotide is codon biased to reflect the codon bias of the host alga.

The disclosure also provides a salt tolerant eukaryotic alga further comprising one or more recombinant polynucleotide sequences encoding proteins that confer resistance to herbicides, in which each of the proteins confers resistance to a different herbicide. In some embodiments, an herbicide resistant alga transformed with herbicide resistance genes is resistant to two or more herbicides that inhibit different amino acid biosynthesis pathways, for example, glyphosate and sulfonylureas, or glyphosate and phosphinothricin. In some embodiments, an herbicide resistant alga transformed with herbicide resistance genes is resistant to two or more herbicides, in which at least one herbicide inhibits an amino acid biosynthesis pathway, and at least one herbicide does not inhibit an amino acid biosynthesis pathway. For example, an herbicide resistant alga can include recombinant genes conferring glyphosate resistance and resistance to norflurazon.

In some embodiments of an alga comprising two or more recombinant polynucleotide sequences encoding proteins that confer resistance to herbicides, at least one of the recombinant polynucleotides encodes an endogenous protein conferring herbicide resistance. In some embodiments, at least one of the polynucleotides encodes an exogenous protein conferring herbicide resistance.

Also disclosed herein are methods of producing one or more biomolecules, in which the methods include engineering an alga by knocking out one or more genes thereby conferring salt tolerance, growing the alga in the presence of the elevated salt concentrations, and harvesting one or more biomolecules from the alga or algal media. The methods in some embodiments include isolating the one or more biomolecules.

The genetically engineered salt tolerant alga is grown in media containing a concentration of a salt that permits growth of the transformed alga, but inhibits growth of the same species of alga that is not engineered to confer resistance to the salt. In some embodiments, the concentration of salt in the media in which the genetically engineered alga is grown to produce a biomolecule or product inhibits the growth of at least one other algal species. In some embodiments, the concentration of salt in the media in which the genetically engineered alga is grown to produce a biomolecule or product inhibits the growth of at least one bacterial species or at least one fungal species. The concentration for optimal bioproduction by the host alga and inhibition of growth of other non-transformed species can be empirically determined.

In some embodiments, genetically engineered salt tolerant algae that include one or more recombinant polynucleotides encoding proteins each conferring resistance to a different herbicide are grown in media containing one or more herbicides. The one or more herbicides in combination can inhibit the growth of any combination of at least one algal species, at least one bacterial species, and at least one fungal species.

A product (for example fuel product, fragrance product, insecticide product, commercial product, therapeutic product) may be produced by an algal culture by a method that comprises the step of growing/culturing a salt tolerant alga in media that includes elevated concentrations of one or more salts such as NaCl or LiCl or both. The methods herein can further comprise the step of collecting a product produced by the organism. The product can be the product of an exogenous nucleotide transformed into the alga. In some embodiments, the product (for example fuel product, fragrance product, insecticide product) is collected by harvesting the organism. The product may then be extracted from the organism.

In one embodiment, methods are provided for producing a biomass-degrading enzyme in an alga, in which the methods include engineering the alga to knock out one or more genes thereby conferring salt tolerance to the alga and transforming the alga with a sequence encoding an exogenous biomass-degrading enzyme or which promotes increased expression of an endogenous biomass-degrading enzyme; growing the alga in the presence of elevated concentrations of one or more salts and under conditions which allow for production of the biomass-degrading enzyme, in which the salt is in sufficient concentration to inhibit growth of the alga which has not been engineered for salt tolerance, to producing the biomass-degrading enzyme. The methods in some embodiments include isolating the biomass-degrading enzyme.

In some embodiments, the expression of the product (for example fuel product, fragrance product, insecticide product) is inducible. The product may be induced to be expressed. Expression may be inducible by light. In yet other embodiments, the production of the product is autoregulatable. The product may form a feedback loop, wherein when the product (for example fuel product, fragrance product, insecticide product) reaches a certain level, expression of the product may be inhibited. In other embodiments, the level of a metabolite of the organism inhibits expression of the product. For example, endogenous ATP produced by the organism as a result of increased energy production to express the product, may form a feedback loop to inhibit expression of the product. In yet another embodiment, production of the product may be inducible, for example, by light or an exogenous agent. For example, an expression vector for effecting production of a product in the host organism may comprise an inducible regulatory control sequence that is activated or inactivated by an exogenous agent.

The methods herein may further comprise the step of providing to the organism a source of inorganic carbons, such as flue gas. In some instances, the inorganic carbon source provides all of the carbons necessary for making the product (for example, fuel product). The growing/culturing step can occur in a suitable medium, such as one that has minerals and/or vitamins in addition to elevated concentrations of one or more salts.

The methods herein comprise selecting genes that are useful to produce products, such as fuels, fragrances, therapeutic compounds, and insecticides, transforming genetically engineered salt tolerant algae with such gene(s), and growing such algae in the presence of elevated concentrations of one or more salts under conditions suitable to allow the product to be produced. Organisms can be cultured in conventional fermentation bioreactors, which include, but are not limited to, batch, fed-batch, cell recycle, and continuous fermentors. Further, they may be grown in photobioreactors (see for example US Appl. Publ. No. 20050260553; U.S. Pat. Nos. 5,958,761; 6,083,740). Culturing can also be conducted in shake flasks, test tubes, microtiter dishes, and petri plates. Culturing is carried out at a temperature, pH and oxygen content appropriate for the recombinant cell and at a salt concentration that permits growth and bioproduction by the algae.

The genetically engineered, salt tolerant algae and methods provided herein can expand the culturing conditions of the algae to larger areas that may be open and, in the absence of resistance, subject to contamination of the culture, for example, on land, such as in landfills. In some cases, organism(s) are grown near ethanol production plants or other facilities or regions (for example, cities, highways, etc.) generating $CO_2$. As such, the methods herein contemplate business methods for selling carbon credits to ethanol plants or other facilities or regions generating $CO_2$ while making fuels by growing one or more of the modified organisms described herein in the presence of elevated concentrations of one or more salts.

Host Cells or Host Organisms

Biomass useful in the methods and systems described herein can be obtained from host cells or host organisms that have been modified (e.g. genetically engineered) to be, for example, salt tolerant, herbicide resistant, or sodium hypochlorite resistant, as compared to an unmodified organism. In addition, the host cells or host organism can be further modified to express an exogenous or endogenous protein, such as a protein involved in the isoprenoid biosynthetic pathway or a protein involved in the accumulation and/or secretion of fatty acids, glycerol lipids, or oils.

A host cell can contain a polynucleotide encoding a polypeptide of the present disclosure. In some embodiments, a host cell is part of a multicellular organism. In other embodiments, a host cell is cultured as a unicellular organism.

Host organisms can include any suitable host, for example, a microorganism. Microorganisms which are useful for the methods described herein include, for example, photosynthetic bacteria (e.g., cyanobacteria), non-photosynthetic bacteria (e.g., *E. coli*), yeast (e.g., *Saccharomyces cerevisiae*), and algae (e.g., microalgae such as *Chlamydomonas reinhardtii*).

Examples of host organisms that can be transformed with a polynucleotide of interest (for example, a polynucleotide that encodes a protein involved in the isoprenoid biosynthesis pathway) include vascular and non-vascular organisms. The organism can be prokaryotic or eukaryotic. The organism can be unicellular or multicellular. A host organism is an organism comprising a host cell. In other embodiments, the host organism is photosynthetic. A photosynthetic organism is one that naturally photosynthesizes (e.g., an alga) or that is genetically engineered or otherwise modified to be photosynthetic. In some instances, a photosynthetic organism may be transformed with a construct or vector of the disclosure which renders all or part of the photosynthetic apparatus inoperable.

By way of example, a non-vascular photosynthetic microalga species (for example, *C. reinhardtii*, *Nannochloropsis oceania*, *N. salina*, *D. salina*, *H. pluvalis*, *S. dimorphus*, *D. viridis*, *Chlorella* sp., and *D. teriolecta*) can be genetically engineered to produce a polypeptide of interest, for example a fusicoccadiene synthase or an FPP synthase. Production of a fusicoccadiene synthase or an FPP synthase in these microalgae can be achieved by engineering the microalgae to express the fusicoccadiene synthase or FPP synthase in the algal chloroplast or nucleus.

In other embodiments the host organism is a vascular plant. Non-limiting examples of such plants include various monocots and dicots, including high oil seed plants such as high oil seed *Brassica* (e.g., *Brassica nigra*, *Brassica napus*, *Brassica hirta*, *Brassica rapa*, *Brassica campestris*, *Brassica carinata*, and *Brassica juncea*), soybean (*Glycine max*), castor bean (*Ricinus communis*), cotton, safflower (*Carthamus tinctorius*), sunflower (*Helianthus annuus*), flax (*Linum usitatissimum*), corn (*Zea mays*), coconut (*Cocos nucifera*), palm (*Elaeis guineensis*), oil nut trees such as olive (*Olea europaea*), sesame, and peanut (*Arachis hipogaea*), as well as *Arabidopsis*, tobacco, wheat, barley, oats, amaranth, potato, rice, tomato, and legumes (e.g., peas, beans, lentils, alfalfa, etc.).

The host cell can be prokaryotic. Examples of some prokaryotic organisms of the present disclosure include, but are not limited to, cyanobacteria (e.g., *Synechococcus*, *Synechocystis*, *Athrospira*, *Anacytis*, *Anabaena*, *Nostoc*, *Spirulina*, *Fremyella*, *Gleocapsa*, *Oscillatoria*, and, *Pseudoanabaena*). Suitable prokaryotic cells include, but are not limited to, any of a variety of laboratory strains of *Escherichia coli*, *Lactobacillus* sp., *Salmonella* sp., and *Shigella* sp. (for example, as described in Carrier et al. (1992) J. Immunol. 148:1176-1181; U.S. Pat. No. 6,447,784; and Sizemore et al. (1995) Science 270:299-302). Examples of *Salmonella* strains which can be employed in the present disclosure include, but are not limited to, *Salmonella typhi* and *S. typhimurium*. Suitable *Shigella* strains include, but are not limited to, *Shigella flexneri*, *Shigella sonnei*, and *Shigella disenteriae*. Typically, the laboratory strain is one that is non-pathogenic. Non-limiting examples of other suitable bacteria include, but are not limited to, *Pseudomonas pudita*, *Pseudomonas aeruginosa*, *Pseudomonas mevalonii*, *Rhodobacter sphaeroides*, *Rhodobacter capsulatus*, *Rhodospirillum rubrum*, and *Rhodococcus* sp.

In some embodiments, the host organism is eukaryotic (e.g. green algae, red algae, brown algae). In some embodiments, the algae is a green algae, for example, a Chlorophycean. The algae can be unicellular or multicellular. Suitable eukaryotic host cells include, but are not limited to, yeast cells, insect cells, plant cells, fungal cells, and algal cells. Suitable eukaryotic host cells include, but are not limited to, *Pichia pastoris*, *Pichia finlandica*, *Pichia trehalophila*, *Pichia koclamae*, *Pichia membranaefaciens*, *Pichia opuntiae*, *Pichia thermotolerans*, *Pichia salictaria*, *Pichia guercuum*, *Pichia pijperi*, *Pichia stiptis*, *Pichia methanolica*, *Pichia* sp., *Saccharomyces cerevisiae*, *Saccharomyces* sp., *Hansenula polymorpha*, *Kluyveromyces* sp., *Kluyveromyces lactis*, *Candida albicans*, *Aspergillus nidulans*, *Aspergillus niger*, *Aspergillus oryzae*, *Trichoderma reesei*, *Chrysosporium lucknowense*, *Fusarium* sp., *Fusarium gramineum*, *Fusarium venenatum*, *Neurospora crassa*, and *Chlamydomonas reinhardtii*.

In some embodiments, eukaryotic microalgae, such as for example, a *Chlamydomonas*, *Volvacales*, *Dunaliella*, *Scenedesmus*, *Chlorella*, or *Hematococcus* species, are used in the disclosed methods. In other embodiments, the host cell is *Chlamydomonas reinhardtii*, *Dunaliella salina*, *Haematococcus pluvialis*, *Nannochloropsis oceania*, *N. salina*. *Scenedesmus dimorphus*, *Chlorella* spp., *D. viridis*, or *D. tertiolecta*.

In some instances the organism is a rhodophyte, chlorophyte, heterokontophyte, tribophyte, glaucophyte, chlorarachniophyte, euglenoid, haptophyte, cryptoronad, dinoflagellum, or phytoplankon.

In some instances a host organism is vascular and photosynthetic. Examples of vascular plants include, but are not limited to, angiosperms, gymnosperms, rhyniophytes, or other tracheophytes.

In some instances a host organism is non-vascular and photosynthetic. As used herein, the term "non-vascular photosynthetic organism," refers to any macroscopic or microscopic organism, including, but not limited to, algae, cyanobacteria and photosynthetic bacteria, which does not have a vascular system such as that found in vascular plants. Examples of non-vascular photosynthetic organisms include bryophtyes, such as marchantiophytes or anthocerotophytes. In some instances the organism is a cyanobacteria. In some instances, the organism is algae (e.g., macroalgae or microalgae). The algae can be unicellular or multicellular algae. For example, the microalgae *Chlamydomonas reinhardtii* may be transformed with a vector, or a linearized portion thereof, encoding one or more proteins of interest (e.g., a protein involved in the isoprenoid biosynthesis pathway).

Methods for algal transformation are described in U.S. Provisional Patent Application No. 60/142,091. The methods of the present disclosure can be carried out using algae, for example, the microalga, *C. reinhardtii*. The use of microalgae to express a polypeptide or protein complex according to a method of the disclosure provides the advantage that large populations of the microalgae can be grown, including commercially (Cyanotech Corp.; Kailua-Kona Hi.), thus allowing for production and, if desired, isolation of large amounts of a desired product.

The vectors of the present disclosure may be capable of stable or transient transformation of multiple photosynthetic organisms, including, but not limited to, photosynthetic bacteria (including cyanobacteria), cyanophyta, prochlorophyta, rhodophyta, chlorophyta, pyrrophyta, heterokontophyta, tribophyta, glaucophyta, chlorarachniophytes, euglenophyta, euglenoids, haptophyta, chrysophyta (including diatoms), cryptophyta, cryptomonads, dinophyta, dinoflagellata, pyrmnesiophyta, bacillariophyta, xanthophyta, eustigmatophyta, raphidophyta, phaeophyta, and phytoplankton. Other vectors of the present disclosure are capable of stable or transient transformation of, for example, *C. reinhardtii, N. oceania, N salina, D. salina, H. pluvalis, S. dimorphus, D. viridis*, or *D. tertiolecta*.

Examples of appropriate hosts, include but are not limited to: bacterial cells, such as *E. coli, Streptomyces, Salmonella typhimurium*; fungal cells, such as yeast; insect cells, such as *Drosophila* S2 and *Spodoptera* Sf9; animal cells, such as CHO, COS or Bowes melanoma; adenoviruses; and plant cells. The selection of an appropriate host is deemed to be within the scope of those skilled in the art.

Polynucleotides selected and isolated as described herein are introduced into a suitable host cell. A suitable host cell is any cell which is capable of promoting recombination and/or reductive reassortment. The selected polynucleotides can be, for example, in a vector which includes appropriate control sequences. The host cell can be, for example, a higher eukaryotic cell, such as a mammalian cell, or a lower eukaryotic cell, such as a yeast cell, or the host cell can be a prokaryotic cell, such as a bacterial cell. Introduction of a construct (vector) into the host cell can be effected by, for example, calcium phosphate transfection, DEAE-Dextran mediated transfection, or electroporation.

Recombinant polypeptides, including protein complexes, can be expressed in plants, allowing for the production of crops of such plants and, therefore, the ability to conveniently produce large amounts of a desired product. Accordingly, the methods of the disclosure can be practiced using any plant, including, for example, microalga and macroalgae, (such as marine algae and seaweeds), as well as plants that grow in soil.

In one embodiment, the host cell is a plant. The term "plant" is used broadly herein to refer to a eukaryotic organism containing plastids, such as chloroplasts, and includes any such organism at any stage of development, or to part of a plant, including a plant cutting, a plant cell, a plant cell culture, a plant organ, a plant seed, and a plantlet. A plant cell is the structural and physiological unit of the plant, comprising a protoplast and a cell wall. A plant cell can be in the form of an isolated single cell or a cultured cell, or can be part of higher organized unit, for example, a plant tissue, plant organ, or plant. Thus, a plant cell can be a protoplast, a gamete producing cell, or a cell or collection of cells that can regenerate into a whole plant. As such, a seed, which comprises multiple plant cells and is capable of regenerating into a whole plant, is considered plant cell for purposes of this disclosure. A plant tissue or plant organ can be a seed, protoplast, callus, or any other groups of plant cells that is organized into a structural or functional unit. Particularly useful parts of a plant include harvestable parts and parts useful for propagation of progeny plants. A harvestable part of a plant can be any useful part of a plant, for example, flowers, pollen, seedlings, tubers, leaves, stems, fruit, seeds, and roots. A part of a plant useful for propagation includes, for example, seeds, fruits, cuttings, seedlings, tubers, and rootstocks.

A method of the disclosure can generate a plant containing genomic DNA (for example, a nuclear and/or plastid genomic DNA) that is genetically modified to contain a stably integrated polynucleotide (for example, as described in Hager and Bock, *Appl. Microbiol. Biotechnol.* 54:302-310, 2000). Accordingly, the present disclosure further provides a transgenic plant, e.g. *C. reinhardtii*, which comprises one or more chloroplasts containing a polynucleotide encoding one or more exogenous or endogenous polypeptides, including polypeptides that can allow for secretion of fuel products and/or fuel product precursors (e.g., isoprenoids, fatty acids, lipids, triglycerides). A photosynthetic organism of the present disclosure comprises at least one host cell that is modified to generate, for example, a fuel product or a fuel product precursor.

Some of the host organisms useful in the disclosed embodiments are, for example, are extremophiles, such as hyperthermophiles, psychrophiles, psychrotrophs, halophiles, barophiles and acidophiles. Some of the host organisms which may be used to practice the present disclosure are halophilic (e.g., *Dunaliella salina, D. viridis*, or *D. tertiolecta*). For example, *D. salina* can grow in ocean water and salt lakes (for example, salinity from 30-300 parts per thousand) and high salinity media (e.g., artificial seawater medium, seawater nutrient agar, brackish water medium, and seawater medium). In some embodiments of the disclosure, a host cell expressing a protein of the present disclosure can be grown in a liquid environment which is, for example, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.1, 4.2, 4.3 molar or higher concentrations of sodium chloride. One of skill in the art will recognize that other salts (sodium salts, calcium salts, potassium salts, or other salts) may also be present in the liquid environments.

Where a halophilic organism is utilized for the present disclosure, it may be transformed with any of the vectors described herein. For example, *D. salina* may be transformed with a vector which is capable of insertion into the chloroplast or nuclear genome and which contains nucleic acids which encode a protein (e.g., an FPP synthase or a fusicoccadiene synthase). Transformed halophilic organisms may then be grown in high-saline environments (e.g., salt lakes, salt ponds, and high-saline media) to produce the products (e.g., lipids) of interest. Isolation of the products may involve removing a transformed organism from a high-saline environment prior to extracting the product from the organism. In instances where the product is secreted into the surrounding environment, it may be necessary to desalinate the liquid environment prior to any further processing of the product.

The present disclosure further provides compositions comprising a genetically modified host cell. A composition comprises a genetically modified host cell; and will in some embodiments comprise one or more further components, which components are selected based in part on the intended use of the genetically modified host cell. Suitable components include, but are not limited to, salts; buffers; stabilizers; protease-inhibiting agents; cell membrane- and/or cell wall-preserving compounds, e.g., glycerol and dimethylsulfoxide; and nutritional media appropriate to the cell.

For the production of a protein, for example, an isoprenoid or isoprenoid precursor compound, a host cell can be, for example, one that produces, or has been genetically modified to produce, one or more enzymes in a prenyl transferase pathway and/or a mevalonate pathway and/or an isoprenoid biosynthetic pathway. In some embodiments, the host cell is one that produces a substrate of a prenyl transferase, isoprenoid synthase or mevalonate pathway enzyme.

In some embodiments, a genetically modified host cell is a host cell that comprises an endogenous mevalonate pathway and/or isoprenoid biosynthetic pathway and/or prenyl transferase pathway. In other embodiments, a genetically modified host cell is a host cell that does not normally produce mevalonate or IPP via a mevalonate pathway, or FPP, GPP or GGPP via a prenyl transferase pathway, but has been genetically modified with one or more polynucleotides comprising nucleotide sequences encoding one or more mevalonate pathway, isoprenoid synthase pathway or prenyl transferase pathway enzymes (for example, as described in U.S. Patent Publication No. 2004/005678; U.S. Patent Publication No. 2003/0148479; and Martin et al. (2003) Natl. Biotech. 21(7):796-802).

Culturing of Cells or Organisms

An organism may be grown under conditions which permit photosynthesis, however, this is not a requirement (e.g., a host organism may be grown in the absence of light). In some instances, the host organism may be genetically modified in such a way that its photosynthetic capability is diminished or destroyed. In growth conditions where a host organism is not capable of photosynthesis (e.g., because of the absence of light and/or genetic modification), typically, the organism will be provided with the necessary nutrients to support growth in the absence of photosynthesis. For example, a culture medium in (or on) which an organism is grown, may be supplemented with any required nutrient, including an organic carbon source, nitrogen source, phosphorous source, vitamins, metals, lipids, nucleic acids, micronutrients, and/or an organism-specific requirement. Organic carbon sources include any source of carbon which the host organism is able to metabolize including, but not limited to, acetate, simple carbohydrates (e.g., glucose, sucrose, and lactose), complex carbohydrates (e.g., starch and glycogen), proteins, and lipids. One of skill in the art will recognize that not all organisms will be able to sufficiently metabolize a particular nutrient and that nutrient mixtures may need to be modified from one organism to another in order to provide the appropriate nutrient mix.

Optimal growth of organisms occurs usually at a temperature of about 20° C. to about 25° C., although some organisms can still grow at a temperature of up to about 35° C. Active growth is typically performed in liquid culture. If the organisms are grown in a liquid medium and are shaken or mixed, the density of the cells can be anywhere from about 1 to $5 \times 10^8$ cells/ml at the stationary phase. For example, the density of the cells at the stationary phase for *Chlamydomonas* sp. can be about 1 to $5 \times 10^7$ cells/ml; the density of the cells at the stationary phase for *Nannochloropsis* sp, can be about 1 to $5 \times 10^8$ cells/ml; the density of the cells at the stationary phase for *Scenedesmus* sp. can be about 1 to $5 \times 10^7$ cells/ml; and the density of the cells at the stationary phase for *Chlorella* sp. can be about 1 to $5 \times 10^8$ cells/ml. Exemplary cell densities at the stationary phase are as follows: *Chlamydomonas* sp. can be about $1 \times 10^7$ cells/ml; *Nannochloropsis* sp. can be about $1 \times 10^8$ cells/ml; *Scenedesmus* sp. can be about $1 \times 10^7$ cells/ml; and *Chlorella* sp. can be about $1 \times 10^8$ cells/ml. An exemplary growth rate may yield, for example, a two to four fold increase in cells per day, depending on the growth conditions. In addition, doubling times for organisms can be, for example, 5 hours to 30 hours. The organism can also be grown on solid media, for example, media containing about 1.5% agar, in plates or in slants.

One source of energy is fluorescent light that can be placed, for example, at a distance of about 1 inch to about two feet from the organism. Examples of types of fluorescent lights includes, for example, cool white and daylight. Bubbling with air or $CO_2$ improves the growth rate of the organism. Bubbling with $CO_2$ can be, for example, at 1% to 5% $CO_2$. If the lights are turned on and off at regular intervals (for example, 12:12 or 14:10 hours of light:dark) the cells of some organisms will become synchronized.

Long term storage of organisms can be achieved by streaking them onto plates, sealing the plates with, for example, Parafilm™, and placing them in dim light at about 10° C. to about 18° C. Alternatively, organisms may be grown as streaks or stabs into agar tubes, capped, and stored at about 10° C. to about 18° C. Both methods allow for the storage of the organisms for several months.

For longer storage, the organisms can be grown in liquid culture to mid to late log phase and then supplemented with a penetrating cryoprotective agent like DMSO or MeOH, and stored at less than −130° C. An exemplary range of DMSO concentrations that can be used is 5 to 8%. An exemplary range of MeOH concentrations that can be used is 3 to 9%.

For longer Organisms can be grown on a defined minimal medium (for example, high salt medium (HSM), modified artificial sea water medium (MASM), or F/2 medium) with light as the sole energy source. In other instances, the organism can be grown in a medium (for example, tris acetate phosphate (TAP) medium), and supplemented with an organic carbon source. Organisms, such as algae, can grow naturally in fresh water or marine water. Culture media for freshwater algae can be, for example, synthetic media, enriched media, soil water media, and solidified media, such as agar. Various culture media have been developed and used for the isolation and cultivation of fresh water algae and are described in Watanabe. M. W. (2005). Freshwater Culture Media. In R. A. Andersen (Ed.), Algal Culturing Techniques (pp. 13-20). Elsevier Academic Press. Culture media for marine algae can be, for example, artificial seawater media or natural seawater media. Guidelines for the preparation of media are described in Harrison, P. J. and Berges, J. A. (2005). Marine Culture Media. In R. A. Andersen (Ed.), Algal Culturing Techniques (pp. 21-33). Elsevier Academic Press.

Organisms may be grown in outdoor open water, such as ponds, the ocean, seas, rivers, waterbeds, marshes, shallow pools, lakes, aqueducts, and reservoirs. When grown in water, the organism can be contained in a halo-like object comprised of lego-like particles. The halo-like object encircles the organism and allows it to retain nutrients from the water beneath while keeping it in open sunlight.

In some instances, organisms can be grown in containers wherein each container comprises one or two organisms, or a plurality of organisms. The containers can be configured to float on water. For example, a container can be filled by a combination of air and water to make the container and the organism(s) in it buoyant. An organism that is adapted to grow in fresh water can tins be grown in salt water (i.e., the ocean) and vice versa. This mechanism allows for automatic death of the organism if there is any damage to the container.

Culturing techniques for algae are well know to one of skill in the art and are described, for example, in Freshwater Culture Media. In R. A. Andersen (Ed.), Algal Culturing Techniques. Elsevier Academic Press.

Because photosynthetic organisms, for example, algae, require sunlight, $CO_2$ and water for growth, they can be cultivated in, for example, open ponds and lakes. However, these open systems are more vulnerable to contamination than a closed system. One challenge with using an open system is that the organism of interest may not grow as quickly as a potential invader. This becomes a problem when another organism invades the liquid environment in which the organism of interest is growing, and the invading organism has a faster growth rate and takes over the system.

In addition, in open systems there is less control over water temperature, $CO_2$ concentration, and lighting conditions. The growing season of the organism is largely dependent on location and, aside from tropical areas, is limited to the warmer months of the year. In addition, in an open system, the number of different organisms that can be grown is limited to those that are able to survive in the chosen location. An open system, however, is cheaper to set up and/or maintain than a closed system.

Another approach to growing an organism is to use a semi-closed system, such as covering the pond or pool with a structure, for example, a "greenhouse-type" structure. While this can result in a smaller system, it addresses many of the problems associated with an open system. The advantages of a semi-closed system are that it can allow for a greater number of different organisms to be grown, it can allow for an organism to be dominant over an invading organism by allowing the organism of interest to out compete the invading organism for nutrients required for its growth, and it can extend the growing season for the organism. For example, if the system is heated, the organism can grow year round.

A variation of the pond system is an artificial pond, for example, a raceway pond. In these ponds, the organism, water, and nutrients circulate around a "racetrack." Paddlewheels provide constant motion to the liquid in the racetrack, allowing for the organism to be circulated back to the surface of the liquid at a chosen frequency. Paddlewheels also provide a source of agitation and oxygenate the system. These raceway ponds can be enclosed, for example, in a building or a greenhouse, or can be located outdoors.

Raceway ponds are usually kept shallow because the organism needs to be exposed to sunlight, and sunlight can only penetrate the pond water to a limited depth. The depth of a raceway pond can be, for example, about 4 to about 12 inches. In addition, the volume of liquid that can be contained in a raceway pond can be, for example, about 200 liters to about 600,000 liters.

The raceway ponds can be operated in a continuous manner, with, for example, $CO_2$ and nutrients being constantly fed to the ponds, while water containing the organism is removed at the other end.

If the raceway pond is placed outdoors, there are several different ways to address the invasion of an unwanted organism. For example, the pH or salinity of the liquid in which the desired organism is in can be such that the invading organism either slows down its growth or dies.

Also, chemicals can be added to the liquid, such as bleach, or a pesticide can be added to the liquid, such as glyphosate. In addition, the organism of interest can be genetically modified such that it is better suited to survive in the liquid environment. Any one or more of the above strategies can be used to address the invasion of an unwanted organism.

Alternatively, organisms, such as algae, can be grown in closed structures such as photobioreactors, where the environment is under stricter control than in open systems or semi-closed systems. A photobioreactor is a bioreactor which incorporates some type of light source to provide photonic energy input into the reactor. The term photobioreactor can refer to a system closed to the environment and having no direct exchange of gases and contaminants with the environment. A photobioreactor can be described as an enclosed, illuminated culture vessel designed for controlled biomass production of prototrophic liquid cell suspension cultures. Examples of photobioreactors include, for example, glass containers, plastic tubes, tanks, plastic sleeves, and bags. Examples of light sources that can be used to provide the energy required to sustain photosynthesis include, for example, fluorescent bulbs, LEDs, and natural sunlight. Because these systems are closed everything that the organism needs to grow (for example, carbon dioxide, nutrients, water, and light) must be introduced into the bioreactor.

Photobioreactors, despite the costs to set up and maintain them, have several advantages over open systems, they can, for example, prevent or minimize contamination, permit axenic organism cultivation of monocultures (a culture consisting of only one species of organism), offer better control over the culture conditions (for example, pH, light, carbon dioxide, and temperature), prevent water evaporation, lower carbon dioxide losses due to out gassing, and permit higher cell concentrations.

On the other hand, certain requirements of photobioreactors, such as cooling, mixing, control of oxygen accumulation and biofouling, make these systems more expensive to build and operate than open systems or semi-closed systems.

Photobioreactors can be set up to be continually harvested (as is with the majority of the larger volume cultivation systems), or harvested one batch at a time (for example, as with polyethlyene bag cultivation). A batch photobioreactor is set up with, for example, nutrients, an organism (for example, algae), and water, and the organism is allowed to grow until the batch is harvested. A continuous photobioreactor can be harvested, for example, either continually, daily, or at fixed time intervals.

High density photobioreactors are described in, for example, Lee, et al., Biotech. Bioengineering 44:1161-1167, 1994. Other types of bioreactors, such as those for sewage and waste water treatments, are described in, Sawayamra, et al., Appl. Micro. Biotech., 41:729-731, 1994. Additional examples of photobioreactors are described in, U.S. Appl. Pub., No. 2005/0260553, U.S. Pat. Nos. 5,958,761, and 6,083,740. Also, organisms, such as algae may be mass-cultured for the removal of heavy metals (for example, as described in Wilkinson, Biotech, Letters, 11:861-864, 1989), hydrogen (for example, as described in U.S. Patent Application Publication No. 2003/0162273), and pharmaceutical compounds from a water, soil, or other source or sample. Organisms can also be cultured in conventional fermentation bioreactors, which include, but are not limited to, batch, fed-batch, cell recycle, and continuous fermentors. Additional methods of culturing organisms and variations of the methods described herein are known to one of skill in the art.

Organisms can also be grown near ethanol production plants or other facilities or regions (e.g., cities and highways) generating $CO_2$. As such, the methods herein contemplate business methods for selling carbon credits to ethanol plants or other facilities or regions generating $CO_2$ while making fuels or fuel products by growing one or more of the organisms described herein near the ethanol production plant, facility, or region.

The organism of interest, grown in any of the systems described herein, can be, for example, continually harvested, or harvested one batch at a time.

$CO_2$ can be delivered to any of the systems described herein, for example, by bubbling in $CO_2$ from under the surface of the liquid containing the organism. Also, sparges can be used to inject $CO_2$ into the liquid. Spargers are, for example, porous disc or tube assemblies that are also referred to as Bubblers, Carbonators, Aerators, Porous Stones and Diffusers.

Nutrients that can be used in the systems described herein include, for example, nitrogen (in the form of $NO_3^-$ or $NH_4^+$), phosphorus, and trace metals (Fe, Mg, K, Ca, Co, Cu, Mn, Mo, Zn, V, and B). The nutrients can come, for example, in a solid form or in a liquid form. If the nutrients are in a solid form they can be mixed with, for example, fresh or salt water prior to being delivered to the liquid containing the organism, or prior to being delivered to a photobioreactor.

Organisms can be grown in cultures, for example large scale cultures, where large scale cultures refers to growth of cultures in volumes of greater than about 6 liters, or greater than about 10 liters, or greater than about 20 liters. Large scale growth can also be growth of cultures in volumes of 50 liters or more, 100 liters or more, or 200 liters or more. Large scale growth can be growth of cultures in, for example, ponds, containers, vessels, or other areas, where the pond, container, vessel, or area that contains the culture is for example, at lease 5 square meters, at least 10 square meters, at least 200 square meters, at least 500 square meters, at least 1,500 square meters, at least 2,500 square meters, in area, or greater.

*Chlamydomonas* sp., *Nannochloropsis* sp., *Scenedesmus* sp., and *Chlorella* sp. are exemplary algae that can be cultured as described herein and can grow under a wide array of conditions.

One organism that can be cultured as described herein is a commonly used laboratory species *C. reinhardtii*. Cells of this species are haploid, and can grow on a simple medium of inorganic salts, using photosynthesis to provide energy. This organism can also grow in total darkness if acetate is provided as a carbon source. *C. reinhardtii* can be readily grown at room temperature under standard fluorescent lights. In addition, the cells can be synchronized by placing them on a light-dark cycle. Other methods of culturing *C. reinhardtii* cells are known to one of skill in the art.

Polynucleotides and Polypeptides

In addition to being genetically engineered to be, for example, salt tolerant, herbicide resistant, or sodium hypochlorite resistant, as compared to an unengineered organism, the host cells or host organism can be further modified to express an exogenous or endogenous protein, for example, a protein involved in the isoprenoid biosynthetic pathway or a protein involved in the accumulation and/or secretion of fatty acids, glycerol lipids, or oils.

Also provided are isolated polynucleotides encoding a protein, for example, an FPP synthase, described herein. As used herein "isolated polynucleotide" means a polynucleotide that is free of one or both of the nucleotide sequences which flank the polynucleotide in the naturally-occurring genome of the organism from which the polynucleotide is derived. The term includes, for example, a polynucleotide or fragment thereof that is incorporated into a vector or expression cassette; into an autonomously replicating plasmid or virus; into the genomic DNA of a prokaryote or eukaryote; or that exists as a separate molecule independent of other polynucleotides. It also includes a recombinant polynucleotide that is part of a hybrid polynucleotide, for example, one encoding a polypeptide sequence.

The proteins of the present disclosure can be made by any method known in the art. The protein may be synthesized using either solid-phase peptide synthesis or by classical solution peptide synthesis also known as liquid-phase peptide synthesis. Using Val-Pro-Pro, Enalapril and Lisinopril as starting templates, several series of peptide analogs such as X-Pro-Pro, X-Ala-Pro, and X-Lys-Pro, wherein X represents any amino acid residue, may be synthesized using solid-phase or liquid-phase peptide synthesis. Methods for carrying out liquid phase synthesis of libraries of peptides and oligonucleotides coupled to a soluble oligomeric support have also been described. Bayer, Ernst and Mutter, Manfred, Nature 237: 512-513 (1972); Bayer, Ernst, et al., J. Am. Chem. Soc. 96:7333-7336 (1974); Bonora, Gian Maria, et al., Nucleic Acids Res. 18:3155-3159 (1990). Liquid phase synthetic methods have the advantage over solid phase synthetic methods in that liquid phase synthesis methods do not require a structure present on a first reactant which is suitable for attaching the reactant to the solid phase. Also, liquid phase synthesis methods do not require avoiding chemical conditions which may cleave the bond between the solid phase and the first reactant (or intermediate product). In addition, reactions in a homogeneous solution may give better yields and more complete reactions than those obtained in heterogeneous solid phase/liquid phase systems such as those present in solid phase synthesis.

In oligomer-supported liquid phase synthesis the growing product is attached to a large soluble polymeric group. The product from each step of the synthesis can then be separated from unreacted reactants based on the large difference in size between the relatively large polymer-attached product and the unreacted reactants. This permits reactions to take place in homogeneous solutions, and eliminates tedious purification steps associated with traditional liquid phase synthesis. Oligomer-supported liquid phase synthesis has also been adapted to automatic liquid phase synthesis of peptides. Bayer, Ernst, et al., Peptides: Chemistry, Structure, Biology, 426-432.

For solid-phase peptide synthesis, the procedure entails the sequential assembly of the appropriate amino acids into a peptide of a desired sequence while the end of the growing peptide is linked to an insoluble support. Usually, the carboxyl terminus of the peptide is linked to a polymer from which it can be liberated upon treatment with a cleavage reagent. In a common method, an amino acid is bound to a resin particle, and the peptide generated in a stepwise manner by successive additions of protected amino acids to produce a chain of amino acids. Modifications of the technique described by Merrifield are commonly used. See, e.g., Merrifield, J. Am. Chem. Soc. 96: 2989-93 (1964). In an automated solid-phase method, peptides are synthesized by loading the carboxy-terminal amino acid onto an organic linker (e.g., PAM, 4-oxymethylphenylacetamidomethyl), which is covalently attached to an insoluble polystyrene resin cross-linked with divinyl benzene. The terminal amine may be protected by blocking with t-butyloxycarbonyl. Hydroxyl- and carboxyl-groups are commonly protected by blocking with O-benzyl groups. Synthesis is accomplished in an automated peptide synthesizer, such as that available from Applied Biosystems (Foster City, Calif.). Following synthesis, the product may be removed from the resin. The blocking groups are removed by using hydrofluoric acid or trifluoromethyl sulfonic acid according to established methods. A routine synthesis may produce 0.5 mmole of peptide resin. Following cleavage and purification, a yield of approximately 60 to 70% is typically produced. Purification of the product peptides is accomplished by, for example, crystallizing the peptide from an organic solvent such as methyl-butyl ether, then dissolving in distilled water, and using dialysis (if the molecular weight of the subject peptide is greater than about 500 daltons) or reverse high pressure liquid chromatography (e.g., using a $C^{18}$ column with 0.1% trifluoroacetic acid and acetonitrile as solvents) if the molecular weight of the peptide is less than 500 daltons. Purified peptide may be lyophilized and stored in a dry state until use. Analysis of the resulting peptides may be accomplished using the common methods of analytical high pressure liquid chromatography (HPLC) and electrospray mass spectrometry (ES-MS).

In other cases, a protein, for example, a protein involved in the isoprenoid biosynthesis pathway or in fatty acid synthesis, is produced by recombinant methods. For production of any of the proteins described herein, host cells transformed with an expression vector containing the polynucleotide encoding such a protein can be used. The host cell can be a higher eukaryotic cell, such as a mammalian cell, or a lower eukaryotic cell such as a yeast or algal cell, or the host can be a prokaryotic cell such as a bacterial cell. Introduction of the expression vector into the host cell can be accomplished by a variety of methods including calcium phosphate transfection, DEAE-dextran mediated transfection, polybrene, protoplast fusion, liposomes, direct microinjection into the nuclei, scrape loading, biolistic transformation and electroporation. Large scale production of proteins from recombinant organisms is a well established process practiced on a commercial scale and well within the capabilities of one skilled in the art.

It should be recognized that the present disclosure is not limited to transgenic cells, organisms, and plastids containing a protein or proteins as disclosed herein, but also encompasses such cells, organisms, and plastids transformed with additional nucleotide sequences encoding enzymes involved in fatty acid synthesis. Thus, some embodiments involve the introduction of one or more sequences encoding proteins involved in fatty acid synthesis in addition to a protein disclosed herein. For example, several enzymes in a fatty acid production pathway may be linked, either directly or indirectly, such that products produced by one enzyme in the pathway, once produced, are in close proximity to the next enzyme in the pathway. These additional sequences may be contained in a single vector either operatively linked to a single promoter or linked to multiple promoters, e.g. one promoter for each sequence. Alternatively, the additional coding sequences may be contained in a plurality of additional vectors. When a plurality of vectors are used, they can be introduced into the host cell or organism simultaneously or sequentially.

Additional embodiments provide a plastid, and in particular a chloroplast, transformed with a polynucleotide encoding a protein of the present disclosure. The protein may be introduced into the genome of the plastid using any of the methods described herein or otherwise known in the art. The plastid may be contained in the organism in which it naturally occurs. Alternatively, the plastid may be an isolated plastid, that is, a plastid that has been removed from the cell in which it normally occurs. Methods for the isolation of plastids are known in the art and can be found, for example, in Maliga et al., *Methods in Plant Molecular Biology*, Cold Spring Harbor Laboratory Press, 1995; Gupta and Singh, *J. Biosci.*, 21:819 (1996); and Camara et al. *Plant Physiol.*, 73:94 (1983). The isolated plastid transformed with a protein of the present disclosure can be introduced into a host cell. The host cell can be one that naturally contains the plastid or one in which the plastid is not naturally found.

Also within the scope of the present disclosure are artificial plastid genomes, for example chloroplast genomes, that contain nucleotide sequences encoding any one or more of the proteins of the present disclosure. Methods for the assembly of artificial plastid genomes can be found in co-pending U.S. patent application Ser. No. 12/287,230 filed Oct. 6, 2008, published as U.S. Publication No. 2009/0123977 on May 14, 2009, and U.S. patent application Ser. No. 12/384,893 filed Apr. 8, 2009, published as U.S. Publication No. 2009/0269816 on Oct. 29, 2009, each of which is incorporated by reference in its entirety.

Introduction of Polynucleotide into a Host Organism or Cell

To generate a genetically modified host cell, a polynucleotide, or a polynucleotide cloned into a vector, is introduced stably or transiently into a host cell, using established techniques, including, but not limited to, electroporation, calcium phosphate precipitation, DEAE-dextran mediated transfection, and liposome-mediated transfection. For transformation, a polynucleotide of the present disclosure will generally further include a selectable marker, e.g., any of several well-known selectable markers such as neomycin resistance, ampicillin resistance, tetracycline resistance, chloramphenicol resistance, and kanamycin resistance.

A polynucleotide or recombinant nucleic acid molecule described herein, can be introduced into a cell (e.g., alga cell) using any method known in the art. A polynucleotide can be introduced into a cell by a variety of methods, which are well known in the art and selected, in part, based on the particular host cell. For example, the polynucleotide can be introduced into a cell using a direct gene transfer method such as electroporation or microprojectile mediated (biolistic) transformation using a particle gun, or the "glass bead method," or by pollen-mediated transformation, liposome-mediated transformation, transformation using wounded or enzyme-degraded immature embryos, or wounded or enzyme-degraded embryogenic callus (for example, as described in Potrykus, *Ann. Rev. Plant. Physiol. Plant Mol. Biol.* 42:205-225, 1991).

As discussed above, microprojectile mediated transformation can be used to introduce a polynucleotide into a cell (for example, as described in Klein et al., *Nature* 327:70-73, 1987). This method utilizes microprojectiles such as gold or tungsten, which are coated with the desired polynucleotide by precipitation with calcium chloride, spermidine or polyethylene glycol. The microprojectile particles are accelerated at high speed into a cell using a device such as the BIOLISTIC PD-1000 particle gun (BioRad; Hercules Calif.). Methods for the transformation using biolistic methods are well known in the art (for example, as described in Christou, *Trend in Plant Science* 1:423-431, 1996). Microprojectile mediated transformation has been used, for example, to generate a variety of transgenic plant species, including cotton, tobacco, corn, hybrid poplar and papaya. Important cereal crops such as wheat, oat, barley, sorghum and rice also have been transformed using microprojectile mediated delivery (for example, as described in Duan et al., *Nature Biotech.* 14:494-498, 1996; and Shimamoto, *Curr. Opin. Biotech.* 5:158-162, 1994). The transformation of most dicotyledonous plants is possible with the methods described above. Transformation of monocotyledonous plants also can be transformed using, for example, biolistic methods as described above, protoplast transformation, electroporation of partially permeabilized cells, introduction of DNA using glass fibers, and the glass bead agitation method.

The basic techniques used for transformation and expression in photosynthetic microorganisms are similar to those commonly used for *E. coli, Saccharomyces cerevisiae* and other species, Transformation methods customized for a photosynthetic microorganisms, e.g., the chloroplast of a strain of algae, are known in the art. These methods have been described in a number of texts for standard molecular biological manipulation (see Packer & Glaser, 1988, "Cyanobacteria", Meth. Enzymol., Vol. 167; Weissbach & Weissbach, 1988, "Methods for plant molecular biology," Academic Press, New York, Sambrook, Fritsch & Maniatis, 1989, "Molecular Cloning: A laboratory manual," 2nd edition Cold Spring Harbor Laboratory Press, Cold Spring Harbor, N.Y.; and Clark M S, 1997, Plant Molecular Biology, Springer, N.Y.). These methods include, for example, biolistic devices (See, for example, Sanford, Trends In Biotech. (1988) δ: 299-302, U.S. Pat. No. 4,945,050; electroporation (Fromm et al., Proc. Nat'l. Acad. Sci. (USA) (1985) 82: 5824-5828); use of a laser beam, electroporation, microinjection or any other method capable of introducing DNA into a host cell.

Plastid transformation is a routine and well known method for introducing a polynucleotide into a plant cell chloroplast (see U.S. Pat. Nos. 5,451,513, 5,545,817, and 5,545,818; WO 95/16783; McBride et al., *Proc. Natl. Acad. Sci.*, USA 91:7301-7305, 1994). In some embodiments, chloroplast transformation involves introducing regions of chloroplast DNA flanking a desired nucleotide sequence, allowing for homologous recombination of the exogenous DNA into the target chloroplast genome. In some instances one to 1.5 kb flanking nucleotide sequences of chloroplast genomic DNA may be used. Using this method, point mutations in the chloroplast 16S rRNA and rps12 genes, which confer resistance to spectinomycin and streptomycin, can be utilized as selectable markers for transformation (Svab et al., *Proc. Natl. Acad. Sci., USA* 87:8526-8530, 1990), and can result in stable homoplasmic transformants, at a frequency of approximately one per 100 bombardments of target leaves.

A further refinement in chloroplast transformation/expression technology that facilitates control over the timing and tissue pattern of expression of introduced DNA coding sequences in plant plastid genomes has been described in PCT International Publication WO 95/16783 and U.S. Pat. No. 5,576,198. This method involves the introduction into plant cells of constructs for nuclear transformation that provide for the expression of a viral single subunit RNA polymerase and targeting of this polymerase into the plastids via fusion to a plastid transit peptide. Transformation of plastids with DNA constructs comprising a viral single subunit RNA polymerase-specific promoter specific to the RNA polymerase expressed from the nuclear expression constructs operably linked to DNA coding sequences of interest permits control of the plastid expression constructs in a tissue and/or developmental specific manner in plants comprising both the nuclear polymerase construct and the plastid expression constructs. Expression of the nuclear RNA polymerase coding sequence can be placed under the control of either a constitutive promoter, or a tissue- or developmental stage-specific promoter, thereby extending this control to the plastid expression construct responsive to the plastid-targeted, nuclear-encoded viral RNA polymerase.

When nuclear transformation is utilized, the protein can be modified for plastid targeting by employing plant cell nuclear transformation constructs wherein DNA coding sequences of interest are fused to any of the available transit peptide sequences capable of facilitating transport of the encoded enzymes into plant plastids, and driving expression by employing an appropriate promoter. Targeting of the protein can be achieved by fusing DNA encoding plastid, e.g., chloroplast, leucoplast, amyloplast, etc., transit peptide sequences to the 5' end of DNAs encoding the enzymes. The sequences that encode a transit peptide region can be obtained, for example, from plant nuclear-encoded plastid proteins, such as the small subunit (SSU) of ribulose bisphosphate carboxylase, EPSP synthase, plant fatty acid biosynthesis related genes including fatty acyl-ACP thioesterases, acyl carrier protein (ACP), stearoyl-ACP desaturase, β-ketoacyl-ACP synthase and acyl-ACP thioesterase, or LHCPII genes, etc. Plastid transit peptide sequences can also be obtained from nucleic acid sequences encoding carotenoid biosynthetic enzymes, such as GGPP synthase, phytoene synthase, and phytoene desaturase. Other transit peptide sequences are disclosed in Von Heijne et al. (1991) *Plant Mol. Biol. Rep.* 9: 104; Clark et al. (1989) *J. Biol. Chem.* 264: 17544; della-Cioppa et al. (1987) *Plant Physiol.* 84: 965; Romer et al. (1993) *Biochem. Biophys. Res. Commun.* 196: 1414; and Shah et al. (1986) *Science* 233: 478. Another transit peptide sequence is that of the intact ACCase from *Chlamydomonas* (genbank EDO96563, amino acids 1-33). The encoding sequence for a transit peptide effective in transport to plastids can include all or a portion of the encoding sequence for a particular transit peptide, and may also contain portions of the mature protein encoding sequence associated with a particular transit peptide. Numerous examples of transit peptides that can be used to deliver target proteins into plastids exist, and the particular transit peptide encoding sequences useful in the present disclosure are not critical as long as delivery into a plastid is obtained. Proteolytic processing within the plastid then produces the mature enzyme. This technique has proven successful with enzymes involved in polyhydroxyalkanoate biosynthesis (Nawrath et al. (1994) *Proc. Natl. Acad. Sci. USA* 91: 12760), and neomycin phosphotransferase II (NPT-II) and CP4 EPSPS (Padgette et al. (1995) *Crop Sci.* 35: 1451), for example.

Of interest are transit peptide sequences derived from enzymes known to be imported into the leucoplasts of seeds. Examples of enzymes containing useful transit peptides include those related to lipid biosynthesis (e.g., subunits of the plastid-targeted dicot acetyl-CoA carboxylase, biotin carboxylase, biotin carboxyl carrier protein, α-carboxy-transferase, and plastid-targeted monocot multifunctional acetyl-CoA carboxylase (Mw, 220,000); plastidic subunits of the fatty acid synthase complex (e.g., acyl carrier protein (ACP), malonyl-ACP synthase, KASI, KASII, and KASIII); steroyl-ACP desaturase; thioesterases (specific for short, medium, and long chain acyl ACP); plastid-targeted acyl transferases (e.g., glycerol-3-phosphate and acyl transferase); enzymes involved in the biosynthesis of aspartate family amino acids; phytoene synthase; gibberellic acid biosynthesis (e.g., ent-kaurene synthases 1 and 2); and carotenoid biosynthesis (e.g., lycopene synthase).

Nuclear transformation of eukaryotic algal cells can be by microprojectile mediated transformation, or can be by protoplast transformation, electroporation, introduction of DNA using glass fibers, or the glass bead agitation method, as nonlimiting examples (Kindle, *Proc. Natl. Acad. Sciences USA* 87: 1228-1232 (1990); Shimogawara et al. *Genetics* 148: 1821-1828 (1998)). Markers for nuclear transformation of algae include, without limitation, markers for rescuing auxotrophic strains (e.g., NIT1 and ARG7 in *Chlamydomonas*; Kindle et al. *J. Cell Biol.* 109: 2589-2601 (1989), Debuchy et al. *EMBO J.* 8: 2803-2809 (1989)), as well as dominant selectable markers (e.g., CRY1, aada; Nelson et al. *Mol. Cellular. Biol.* 14: 4011-4019 (1994), Cerutti et al. *Genetics* 145: 97-110 (1997)). In some embodiments, the presence of the knock out is used as a selectable marker for transformants. A knock out sequence can in some embodiments be co-transformed with a second sequence encoding a protein to be produced by the alga (for example, a therapeutic protein, industrial enzyme) or a protein that promotes or enhances production of a commercial, therapeutic, or nutritional product. The second sequence is in some embodiments provided on the same nucleic acid construct as the knock out sequence for transformation into the alga, in which the success of the knock out sequence in activating the gene of interest is used as the selectable marker.

In some embodiments, an alga is transformed with a nucleic acid which encodes a protein of interest, for example, a prenyl transferase, an isoprenoid synthase, or an enzyme capable of converting a precursor into a fuel product or a precursor of a fuel product (e.g., an isoprenoid or fatty acid).

In one embodiment, a transformation may introduce a nucleic acid into a plastid of the host alga (e.g., chloroplast). In another embodiments a transformation may introduce a nucleic acid into the nuclear genome of the host alga. In still another embodiment, a transformation may introduce nucleic acids into both the nuclear genome and into a plastid.

Transformed cells can be plated on selective media following introduction of exogenous nucleic acids. This method may also comprise several steps for screening. A screen of primary transformants can be conducted to determine which clones have proper insertion of the exogenous nucleic acids. Clones which show the proper integration may be propagated and re-screened to ensure genetic stability. Such methodology ensures that the transformants contain the genes of interest. In many instances, such screening is performed by polymerase chain reaction (PCR); however, any other appropriate technique known in the art may be utilized. Many different methods of PCR are known in the art (e.g., nested PCR, real time PCR). For any given screen, one of skill in the art will recognize that PCR components may be varied to achieve optimal screening results. For example, magnesium concentration may need to be adjusted upwards when PCR is performed on disrupted alga cells to which (which chelates magnesium) is added to chelate toxic metals. Following the screening for clones with the proper integration of exogenous nucleic acids, clones can be screened for the presence of the encoded protein(s) and/or products. Protein expression screening can be performed by Western blot analysis and/or enzyme activity assays. Transporter and/or product screening may be performed by any method known in the art, for example ATP turnover assay, substrate transport assay, HPLC or gas chromatography.

The expression of the protein or enzyme can be accomplished by inserting a polynucleotide sequence (gene) encoding the protein or enzyme into the chloroplast or nuclear genome of a microalgae. The modified strain of microalgae can be made homoplasmic to ensure that the polynucleotide will be stably maintained in the chloroplast genome of all descendents. A microalga is homoplasmic for a gene when the inserted gene is present in all copies of the chloroplast genome, for example, it is apparent to one of skill in the art that a chloroplast may contain multiple copies of its genome, and therefore, the term "homoplasmic" or "homoplasmy" refers to the state where all copies of a particular locus of interest are substantially identical. Plastid expression, in which genes are inserted by homologous recombination into all of the several thousand copies of the circular plastid genome present in each plant cell, takes advantage of the enormous copy number advantage over nuclear-expressed genes to permit expression levels that can readily exceed 10% or more of the total soluble plant protein. The process of determining the plasmic state of an organism of the present disclosure involves screening transformants for the presence of exogenous nucleic acids and the absence of wild-type nucleic acids at a given locus of interest.

Vectors

Construct, vector and plasmid are used interchangeably throughout the disclosure. Nucleic acids encoding the proteins described herein, can be contained in vectors, including cloning and expression vectors. A cloning vector is a self-replicating DNA molecule that serves to transfer a DNA segment into a host cell. Three common types of cloning vectors are bacterial plasmids, phages, and other viruses. An expression vector is a cloning vector designed so that a coding sequence inserted at a particular site will be transcribed and translated into a protein. Both cloning and expression vectors can contain nucleotide sequences that allow the vectors to replicate in one or more suitable host cells. In cloning vectors, this sequence is generally one that enables the vector to replicate independently of the host cell chromosomes, and also includes either origins of replication or autonomously replicating sequences.

In some embodiments, a polynucleotide of the present disclosure is cloned or inserted into an expression vector using cloning techniques know to one of skill in the art. The nucleotide sequences may be inserted into a vector by a variety of methods. In the most common method the sequences are inserted into an appropriate restriction endonuclease site(s) using procedures commonly known to those skilled in the art and detailed in, for example, Sambrook et al., Molecular Cloning, A Laboratory Manual, 2nd Ed., Cold Spring Harbor Press, (1989) and Ausubel et al., Short Protocols in Molecular Biology, 2nd Ed., John Wiley & Sons (1992).

Suitable expression vectors include, but are not limited to, baculovirus vectors, bacteriophage vectors, plasmids, phagemids, cosmids, fosmids, bacterial artificial chromosomes, viral vectors (e.g. viral vectors based on vaccinia virus, poliovirus, adenovirus, adeno-associated virus, SV40, and herpes simplex virus), PI-based artificial chromosomes, yeast plasmids, yeast artificial chromosomes, and any other vectors specific for specific hosts of interest (such as E coli and yeast). Thus, for example, a polynucleotide encoding an FPP synthase, can be inserted into anyone of a variety of expression vectors that are capable of expressing the enzyme. Such vectors can include, for example, chromosomal, non-chromosomal and synthetic DNA sequences.

Suitable expression vectors include chromosomal, non-chromosomal and synthetic DNA sequences, for example, SV 40 derivatives; bacterial plasmids; phage DNA; baculovirus; yeast plasmids; vectors derived from combinations of plasmids and phage DNA; and viral DNA such as vaccinia, adenovirus, fowl pox virus, and pseudorabies. In addition, any other vector that is replicable and viable in the host may be used. For example, vectors such as Ble2A, Arg7/2A, and SEnuc357 can be used for the expression of a protein.

Numerous suitable expression vectors are known to those of skill in the art. The following vectors are provided by way of example; for bacterial host cells: pQE vectors (Qiagen), pBluescript plasmids, pNH vectors, lambda-ZAP vectors (Stratagene), pTrc99a, pKK223-3, pDR540, and pRIT2T (Pharmacia); for eukaryotic host cells: pXT1, pSG5 (Stratagene), pSVK3, pBPV, pMSG, pET21a-d(+) vectors (Novagen), and pSVLSV40 (Pharmacia). However, any other plasmid or other vector may be used so long as it is compatible with the host cell.

The expression vector, or a linearized portion thereof, can encode one or more exogenous or endogenous nucleotide sequences. Examples of exogenous nucleotide sequences that can be transformed into a host include genes from bacteria, fungi, plants, photosynthetic bacteria or other algae. Examples of other types of nucleotide sequences that can be transformed into a host, include, but are not limited to, transporter genes, isoprenoid producing genes, genes which encode for proteins which produce isoprenoids with two phosphates (e.g., GPP synthase and/or FPP synthase), genes which encode for proteins which produce fatty acids, lipids, or triglycerides, for example, ACCases, endogenous promoters, and 5' UTRs from the psbA, atpA, or rbcL genes. In some instances, an exogenous sequence is flanked by two homologous sequences.

Homologous sequences are, for example, those that have at least 50%, at least 60%, at least 70%, at least 80%, at least 90%, at least 95%, at least 98%, or at least at least 99% sequence identity to a reference amino acid sequence or nucleotide sequence, for example, the amino acid sequence or nucleotide sequence that is found naturally in the host cell. The first and second homologous sequences enable recombination of the exogenous or endogenous sequence into the genome of the host organism. The first and second homologous sequences can be at least 100, at least 200, at least 300, at least 400, at least 500, or at least 1500 nucleotides in length.

The polynucleotide sequence may comprise nucleotide sequences that are codon biased for expression in the organism being transformed. The skilled artisan is well aware of the "codon-bias" exhibited by a specific host cell in usage of nucleotide codons to specify a given amino acid. Without being bound by theory, by using a host cell's preferred codons, the rate of translation may be greater. Therefore, when synthesizing a gene for improved expression in a host cell, it may be desirable to design the gene such that its frequency of codon usage approaches the frequency of preferred codon usage of the host cell. In some organisms, codon bias differs between the nuclear genome and organelle genomes, thus, codon optimization or biasing may be performed for the target genome (e.g., nuclear codon biased or chloroplast codon biased). In some embodiments, codon biasing occurs before mutagenesis to generate a polypeptide. In other embodiments, codon biasing occurs after mutagenesis to generate a polynucleotide. In yet other embodiments, codon biasing occurs before mutagenesis as well as after mutagenesis. Codon bias is described in detail herein.

In some embodiments, a vector comprises a polynucleotide operably linked to one or more control elements, such as a promoter and/or a transcription terminator. A nucleic acid sequence is operably linked when it is placed into a functional relationship with another nucleic acid sequence. For example, DNA for a presequence or secretory leader is operatively linked to DNA for a polypeptide if it is expressed as a preprotein which participates in the secretion of the polypeptide; a promoter is operably linked to a coding sequence if it affects the transcription of the sequence; or a ribosome binding site is operably linked to a coding sequence if it is positioned so as to facilitate translation. Generally, operably linked sequences are contiguous and, in the case of a secretory leader, contiguous and in reading phase. Linking is achieved by ligation at restriction enzyme sites. If suitable restriction sites are not available, then synthetic oligonucleotide adapters or linkers can be used as is known to those skilled in the art. Sambrook et al., *Molecular Cloning, A Laboratory Manual*, 2$^{nd}$ Ed., Cold Spring Harbor Press, (1989) and Ausubel et al., *Short Protocols in Molecular Biology*, 2$^{nd}$ Ed., John Wiley & Sons (1992).

A vector in some embodiments provides for amplification of the copy number of a polynucleotide. A vector can be, for example, an expression vector that provides for expression of an ACCase, a prenyl transferase, an isoprenoid synthase, or a mevalonate synthesis enzyme in a host cell, e.g., a prokaryotic host cell or a eukaryotic host cell.

A polynucleotide or polynucleotides can be contained in a vector or vectors. For example, where a second (or more) nucleic acid molecule is desired, the second nucleic acid molecule can be contained in a vector, which can, but need not be, the same vector as that containing the first nucleic acid molecule. The vector can be any vector useful for introducing a polynucleotide into a genome and can include a nucleotide sequence of genomic DNA (e.g., nuclear or plastid) that is sufficient to undergo homologous recombination with genomic DNA, for example, a nucleotide sequence comprising about 400 to about 1500 or more substantially contiguous nucleotides of genomic DNA, A regulatory or control element, as the term is used herein, broadly refers to a nucleotide sequence that regulates the transcription or translation of a polynucleotide or the localization of a polypeptide to which it is operatively linked. Examples include, but are not limited to, an RBS, a promoter, enhancer, transcription terminator, an initiation (start) codon, a splicing signal for intron excision and maintenance of a correct reading frame, a STOP codon, an amber or ochre codon, and an IRES. A regulatory element can include a promoter and transcriptional and translational stop signals. Elements may be provided with linkers for the purpose of introducing specific restriction sites facilitating ligation of the control sequences with the coding region of a nucleotide sequence encoding a polypeptide. Additionally, a sequence comprising a cell compartmentalization signal (i.e., a sequence that targets a polypeptide to the cytosol, nucleus, chloroplast membrane or cell membrane) can be attached to the polynucleotide encoding a protein of interest. Such signals are well known in the art and have been widely reported (see, e.g., U.S. Pat. No. 5,776,689).

Promoters are untranslated sequences located generally 100 to 1000 base pairs (bp) upstream from the start codon of a structural gene that regulate the transcription and translation of nucleic acid sequences under their control.

Promoters useful for the present disclosure may come from any source (e.g., viral, bacterial, fungal, protist, and animal). The promoters contemplated herein can be specific to photosynthetic organisms, non-vascular photosynthetic organisms, and vascular photosynthetic organisms (e.g., algae, flowering plants). In some instances, the nucleic acids above are inserted into a vector that comprises a promoter of a photosynthetic organism, e.g., algae. The promoter can be a constitutive promoter or an inducible promoter. A promoter typically includes necessary nucleic acid sequences near the start site of transcription, (e.g., a TATA element). Common promoters used in expression vectors include, but are not limited to, LTR or SV40 promoter, the *E. coli* lac or trp promoters, and the phage lambda PL promoter. Other promoters known to control the expression of genes in prokaryotic or eukaryotic cells can be used and are known to those skilled in the art. Expression vectors may also contain a ribosome binding site for translation initiation, and a transcription terminator. The vector may also contain sequences useful for the amplification of gene expression.

A "constitutive" promoter is a promoter that is active under most environmental and developmental conditions. An "inducible" promoter is a promoter that is active under controllable environmental or developmental conditions. Examples of inducible promoters/regulatory elements include, for example, a nitrate-inducible promoter (for example, as described in Bock et al, *Plant Mol. Biol.* 17:9 (1991)), or a light-inducible promoter, (for example, as described in Feinbaum et al, Mol. Gen. Genet. 226:449 (1991); and Lam and Chua, Science 248:471 (1990)), or a heat responsive promoter (for example, as described in Muller et al., Gene 111: 165-73 (1992)).

In many embodiments, a polynucleotide of the present disclosure includes a nucleotide sequence encoding a protein or enzyme of the present disclosure, where the nucleotide sequence encoding the polypeptide is operably linked to an inducible promoter. Inducible promoters are well known in the art. Suitable inducible promoters include, but are not limited to, the pL of bacteriophage λ; Placo; Ptrp; Ptac (Ptrp-lac hybrid promoter); an isopropyl-beta-D-thiogalactopyranoside (IPTG)-inducible promoter, e.g., a lacZ promoter; a tetracycline-inducible promoter; an arabinose inducible promoter, e.g., $P_{BAD}$ (for example, as described in Guzman et al. (1995) J. Bacteriol. 177:4121-4130); a xylose-inducible promoter, e.g., Pxy1 (for example, as described in Kim et al. (1996) Gene 181:71-76); a GAL1 promoter; a tryptophan promoter; a lac promoter; an alcohol-inducible promoter, e.g., a methanol-inducible promoter, an ethanol-inducible promoter; a raffinose-inducible promoter; and a heat-inducible promoter, e.g., heat inducible lambda $P_L$ promoter and a promoter controlled by a heat-sensitive repressor (e.g., C1857-repressed lambda-based expression vectors; for example, as described in Hoffmann et al. (1999) FEMS Microbiol Lett. 177(2):327-34).

In many embodiments, a polynucleotide of the present disclosure includes a nucleotide sequence encoding a protein or enzyme of the present disclosure, where the nucleotide sequence encoding the polypeptide is operably linked to a constitutive promoter. Suitable constitutive promoters for use in prokaryotic cells are known in the art and include, but are not limited to, a sigma70 promoter, and a consensus sigma70 promoter.

Suitable promoters for use in prokaryotic host cells include, but are not limited to, a bacteriophage T7 RNA polymerase promoter; a trp promoter; a lac operon promoter; a hybrid promoter, e.g., a lac/lac hybrid promoter, a tac/trc hybrid promoter, a trp/lac promoter, a T7/lac promoter; a trc promoter; a tac promoter; an araBAD promoter; in vivo regulated promoters, such as an ssaG promoter or a related promoter (for example, as described in U.S. Patent Publication No. 20040131637), a pagC promoter (for example, as described in Pulkkinen and Miller, J. Bacteriol., 1991: 173 (1): 86-93; and Alpuche-Aranda et al., PNAS, 1992; 89(21): 10079-83), a nirB promoter (for example, as described in Harborne et al. (1992) Mol. Micro, 6:2805-2813; Dunstan et al. (1999) Infect. Immun. 67:5133-5141; McKelvie et al. (2004) Vaccine 22:3243-3255; and Chatfield et al. (1992) Biotechnol. 10:888-892); a sigma70 promoter, e.g., a consensus sigma70 promoter (for example, GenBank Accession Nos. AX798980, AX798961, and AX798183); a stationary phase promoter, e.g., a dps promoter, an spy promoter; a promoter derived from the pathogenicity island SPI-2 (for example, as described in WO96/17951); an actA promoter (for example, as described in Shetron-Rama et al. (2002) Infect. Immun. 70:1087-1096); an rpsM promoter (for example, as described in Valdivia and Falkow (1996). Mol. Microbiol. 22:367-378); a tet promoter (for example, as described in Hillen, W. and Wissmann, A. (1989) In Saenger, W. and Heinemann, U. (eds), Topics in Molecular and Structural Biology, Protein-Nucleic Acid Interaction. Macmillan, London, UK, Vol. 10, pp. 143-162); and an SP6 promoter (for example, as described in Melton et al. (1984) Nucl. Acids Res. 12:7035-7056).

In yeast, a number of vectors containing constitutive or inducible promoters may be used. For a review of such vectors see, Current Protocols in Molecular Biology, Vol. 2, 1988, Ed. Ausubel, et al., Greene Publish. Assoc. & Wiley Interscience, Ch. 13; Grant, et al., 1987, Expression and Secretion Vectors for Yeast, in Methods in Enzymology, Eds. Wu & Grossman, 31987, Acad. Press, N.Y., Vol. 153, pp. 516-544; Glover, 1986, DNA Cloning, Vol. II, IRL Press, Wash., D.C., Ch. 3; Bitter, 1987, Heterologous Gene Expression in Yeast, Methods in Enzymology, Eds. Berger & Kimmel, Acad. Press, N.Y., Vol. 152, pp. 673-684; and The Molecular Biology of the Yeast Saccharomyces, 1982, Eds. Strathern et al., Cold Spring Harbor Press, Vols. I and II. A constitutive yeast promoter such as ADH or LEU2 or an inducible promoter such as GAL may be used (for example, as described in Cloning in Yeast, Ch. 3, R. Rothstein In: DNA Cloning Vol. 11, A Practical Approach, Ed. DM Glover, 1986, IRL Press, Wash., D.C.). Alternatively, vectors may be used which promote integration of foreign DNA sequences into the yeast chromosome.

Non-limiting examples of suitable eukaryotic promoters include CMV immediate early, HSV thymidine kinase, early and late SV40, LTRs from retrovirus, and mouse metallothionein-1. Selection of the appropriate vector and promoter is well within the level of ordinary skill in the art. The expression vector may also contain a ribosome binding site for translation initiation and a transcription terminator. The expression vector may also include appropriate sequences for amplifying expression.

A vector utilized in the practice of the disclosure also can contain one or more additional nucleotide sequences that confer desirable characteristics on the vector, including, for example, sequences such as cloning sites that facilitate manipulation of the vector, regulatory elements that direct replication of the vector or transcription of nucleotide sequences contain therein, and sequences that encode a selectable marker. As such, the vector can contain, for example, one or more cloning sites such as a multiple cloning site, which can, but need not, be positioned such that a exogenous or endogenous polynucleotide can be inserted into the vector and operatively linked to a desired element.

The vector also can contain a prokaryote origin of replication (ori), for example, an E. coli ori or a cosmid ori, thus allowing passage of the vector into a prokaryote host cell, as well as into a plant chloroplast. Various bacterial and viral origins of replication are well known to those skilled in the art and include, but are not limited to the pBR322 plasmid origin, the 2u plasmid origin, and the SV40, polyoma, adenovirus, VSV, and BPV viral origins.

A regulatory or control element, as the term is used herein, broadly refers to a nucleotide sequence that regulates the transcription or translation of a polynucleotide or the localization of a polypeptide to which it is operatively linked. Examples include, but are not limited to, an RBS, a promoter, enhancer, transcription terminator, an initiation (start) codon, a splicing signal for intron excision and maintenance of a correct reading frame, a STOP codon, an amber or ochre codon, an IRES. Additionally, an element can be a cell compartmentalization signal (i.e., a sequence that targets a polypeptide to the cytosol, nucleus, chloroplast membrane or cell membrane). In some aspects of the present disclosure, a cell compartmentalization signal (e.g., a cell membrane targeting sequence) may be ligated to a gene and/or transcript, such that translation of the gene occurs in the chloroplast. In other aspects, a cell compartmentalization signal may be ligated to a gene such that, following translation of the gene, the protein is transported to the cell membrane. Cell compartmentalization signals are well known in the art and have been widely reported (see, e.g., U.S. Pat. No. 5,776,689).

A vector, or a linearized portion thereof, may include a nucleotide sequence encoding a reporter polypeptide or other selectable marker. The term "reporter" or "selectable marker" refers to a polynucleotide (or encoded polypeptide) that confers a detectable phenotype. A reporter generally encodes a detectable polypeptide, for example, a green fluorescent protein or an enzyme such as luciferase, which, when contacted with an appropriate agent (a particular wavelength of light or luciferin, respectively) generates a signal that can be detected by eye or using appropriate instrumentation (for example, as described in Giacomin, *Plant Sci.* 116:59-72, 1996; Scikantha, *J. Bacteriol.* 178:121, 1996; Gerdes, *FEBS Lett.* 389:44-47, 1996; and Jefferson. *EMBO J.* 6:3901-3907, 1997, fl-glucuronidase). A selectable marker generally is a molecule that, when present or expressed in a cell, provides a selective advantage (or disadvantage) to the cell containing the marker, for example, the ability to grow in the presence of an agent that otherwise would kill the cell.

A selectable marker can provide a means to obtain, for example, prokaryotic cells, eukaryotic cells, and/or plant cells that express the marker and, therefore, can be useful as a component of a vector of the disclosure. The selection gene or marker can encode for a protein necessary for the survival or growth of the host cell transformed with the vector. One class of selectable markers are native or modified genes which restore a biological or physiological function to a host cell (e.g., restores photosynthetic capability or restores a metabolic pathway). Other examples of selectable markers include, but are not limited to, those that confer antimetabolite resistance, for example, dihydrofolate reductase, which confers resistance to methotrexate (for example, as described in Reiss, *Plant Physiol.* (*Life Sci. Adv.*) 13:143-149, 1994); neomycin phosphotransferase, which confers resistance to the aminoglycosides neomycin, kanamycin and paromycin (for example, as described in Herrera-Estrella, *EMBO J.* 2:987-995, 1983), hygro, which confers resistance to hygromycin (for example, as described in Marsh, *Gene* 32:481-485, 1984), trpB, which allows cells to utilize indole in place of tryptophan; hisD, which allows cells to utilize histinol in place of histidine (for example, as described in Hartman, *Proc. Natl. Acad. Sci., USA* 85:8047, 1988); mannose-6-phosphate isomerase which allows cells to utilize mannose (for example, as described in PCT Publication Application No. WO 94/20627); ornithine decarboxylase, which confers resistance to the ornithine decarboxylase inhibitor, 2-(difluoromethyl)-DL-ornithine (DFMO; for example, as described in McConlogue, 1987, In: Current Communications in Molecular Biology, Cold Spring Harbor Laboratory ed.); and deaminase from *Aspergillus terreus*, which confers resistance to Blasticidin S (for example, as described in Tamura, *Biosci. Biotechnol. Biochem.* 59:2336-2338, 1995). Additional selectable markers include those that confer herbicide resistance, for example, phosphinothricin acetyltransferase gene, which confers resistance to phosphinothricin (for example, as described in White et al., *Nucl. Acids Res.* 18:1062, 1990; and Spencer et al., *Theor. Appl. Genet.* 79:625-631, 1990), a mutant EPSPV-synthase, which confers glyphosate resistance (for example, as described in Hinchee et al., *BioTechnology* 91:915-922, 1998), a mutant acetolactate synthase, which confers imidazolione or sulfonylurea resistance (for example, as described in Lee et al., EMBO J. 7:1241-1248, 1988), a mutant psbA, which confers resistance to atrazine (for example, as described in Smeda et al., *Plant Physiol.* 103:911-917, 1993), or a mutant protoporphyrinogen oxidase (for example, as described in U.S. Pat. No. 5,767,373), or other markers conferring resistance to an herbicide such as glufosinate. Selectable markers include polynucleotides that confer dihydrofolate reductase (DHFR) or neomycin resistance for eukaryotic cells; tetramycin or ampicillin resistance for prokaryotes such as *E. coli*; and bleomycin, gentamycin, glyphosate, hygromycin, kanamycin, methotrexate, phleomycin, phosphinotricin, spectinomycin, dtreptomycin, streptomycin, sulfonamide and sulfonylurea resistance in plants (for example, as described in Maliga et al., Methods in Plant Molecular Biology, Cold Spring Harbor Laboratory Press, 1995, page 39). The selection marker can have its own promoter or its expression can be driven by a promoter driving the expression of a polypeptide of interest.

Reporter genes greatly enhance the ability to monitor gene expression in a number of biological organisms. Reporter genes have been successfully used in chloroplasts of higher plants, and high levels of recombinant protein expression have been reported. In addition, reporter genes have been used in the chloroplast of *C. reinhardtii*. In chloroplasts of higher plants, β-glucuronidase (uidA, for example, as described in Staub and Maliga, *EMBO J.* 12:601-606, 1993), neomycin phosphotransferase (nptII, for example, as described in Carrer et al., *Mol. Gen. Genet.* 241:49-56, 1993), adenosyl-3-adenyltransf-erase (aadA, for example, as described in Svab and Maliga, *Proc. Natl. Acad. Sci., USA* 90:913-917, 1993), and the *Aequorea victoria* GFP (for example, as described in Sidorov et al., *Plant J.* 19:209-216, 1999) have been used as reporter genes (for example, as described in Heifetz, *Biochemie* 82:655-666, 2000). Each of these genes has attributes that make them useful reporters of chloroplast gene expression, such as ease of analysis, sensitivity, or the ability to examine expression in situ. Based upon these studies, other exogenous proteins have been expressed in the chloroplasts of higher plants such as *Bacillus thuringiensis* Cry toxins, conferring resistance to insect herbivores (for example, as described in Kota et al., *Proc. Natl. Acad. Sci., USA* 96:1840-1845, 1999), or human somatotropin (for example, as described in Staub et al., *Nat. Biotechnol.* 18:333-338, 2000), a potential biopharmaceutical. Several reporter genes have been expressed in the chloroplast of the eukaryotic green alga, *C. reinhardtii*, including aadA (for example, as described in Goldschmidt-Clermont. *Nucl. Acids Res.* 19:4083-4089 1991; and Zerges and Rochaix, *Mol. Cell Biol.* 14:5268-5277, 1994), uidA (for example, as described in Sakamoto et al., *Proc. Natl. Acad. Sci., USA* 90:477-501, 1993; and Ishikura et al., *J. Biosci. Bioeng.* 87:307-314 1999), *Renilla luciferase* (for example, as described in Minko et al., *Mol. Gen. Genet.* 262:421-425, 1999) and the amino glycoside phosphotransferase from *Acinetobacter baumanii*, aphA6 (for example, as described in Bateman and Purton, *Mol. Gen. Genet* 263:404-410, 2000). In one embodiment the protein described herein is modified by the addition of an N-terminal strep tag epitope to add in the detection of protein expression.

In some instances, the vectors of the present disclosure will contain elements such as an *E. coli* or *S. cerevisiae* origin of replication. Such features, combined with appropriate selectable markers, allows for the vector to be "shuttled" between the target host cell and a bacterial and/or yeast cell. The ability to passage a shuttle vector of the disclosure in a secondary host may allow for more convenient manipulation of the features of the vector. For example, a reaction mixture containing the vector and inserted polynucleotide(s) of interest can be transformed into prokaryote host cells such as *E. coli*, amplified and collected using routine methods, and examined to identify vectors containing an insert or construct of interest. If desired, the vector can be further manipulated, for example, by performing site directed mutagenesis of the inserted polynucleotide, then again amplifying and selecting vectors having a mutated polynucleotide of interest. A shuttle vector then can be introduced into plant cell chloroplasts, wherein a polypeptide of interest can be expressed and, if desired, isolated according to a method of the disclosure.

Knowledge of the chloroplast or nuclear genome of the host organism, for example, *C. reinhardtii*, is useful in the construction of vectors for use in the disclosed embodiments. Chloroplast vectors and methods for selecting regions of a chloroplast genome for use as a vector are well known (see, for example, Bock, J. Mol. Biol. 312:425-438, 2001; Staub and Maliga, *Plant Cell* 4:39-45, 1992; and Kavanagh et al., *Genetics* 152:1111-1122, 1999, each of which is incorporated herein by reference). The entire chloroplast genome of *C. reinhardtii* is available to the public on the world wide web, at the URL "biology.duke.edu/chlamy_genome/-chloro.html" (see "view complete genome as text file" link and "maps of the chloroplast genome" link; J. Maul, J. W. Lilly, and D. B. Stern, unpublished results; revised Jan. 28, 2002; to be published as GenBank Acc. No. AF396929; and Maul, J. E., et al. (2002) The Plant Cell, Vol. 14 (2659-2679)). Generally, the nucleotide sequence of the chloroplast genomic DNA that is selected for use is not a portion of a gene, including a regulatory sequence or coding sequence. For example, the selected sequence is not a gene that if disrupted, due to the homologous recombination event, would produce a deleterious effect with respect to the chloroplast. For example, a deleterious effect on the replication of the chloroplast genome or to a plant cell containing the chloroplast. In this respect, the website containing the *C. reinhardtii* chloroplast genome sequence also provides maps showing coding and non-coding regions of the chloroplast genome, thus facilitating selection of a sequence useful for constructing a vector (also described in Maul, J. E., et al. (2002) The Plant Cell, Vol. 14 (2659-2679)). For example, the chloroplast vector, p322, is a clone extending from the Eco (Eco RI) site at about position 143.1 kb to the Xho (Xho I) site at about position 148.5 kb (see, world wide web, at the URL "biology.duke.edu/chlamy_genome/chloro.html", and clicking on "maps of the chloroplast genome" link, and "140-150 kb" link; also accessible directly on world wide web at URL "biology.duke.edu/chlam-y/chloro/chlorol40.html").

In addition, the entire nuclear genome of *C. reinhardtii* is described in Merchant, S. S., et al., Science (2007), 318 (5848):245-250, thus facilitating one of skill in the art to select a sequence or sequences useful for constructing a vector.

For expression of the polypeptide in a host, an expression cassette or vector may be employed. The expression vector will provide a transcriptional and translational initiation region, which may be inducible or constitutive, where the coding region is operably linked under the transcriptional control of the transcriptional initiation region, and a transcriptional and translational termination region. These control regions may be native to the gene, or may be derived from an exogenous source. Expression vectors generally have convenient restriction sites located near the promoter sequence to provide for the insertion of nucleic acid sequences encoding exogenous or endogenous proteins. A selectable marker operative in the expression host may be present.

The nucleotide sequences may be inserted into a vector by a variety of methods. In the most common method the sequences are inserted into an appropriate restriction endonuclease site(s) using procedures commonly known to those skilled in the art and detailed in, for example, Sambrook et al., *Molecular Cloning, A Laboratory Manual, 2nd* Ed., Cold Spring Harbor Press, (1989) and Ausubel et al., *Short Protocols in Molecular Biology, 2nd* Ed., John Wiley & Sons (1992).

The description herein provides that host cells may be transformed with vectors. One of skill in the art will recognize that such transformation includes transformation with circular or linearized vectors, or linearized portions of a vector. Thus, a host cell comprising a vector may contain the entire vector in the cell (in either circular or linear form), or may contain a linearized portion of a vector of the present disclosure. In some instances 0.5 to 1.5 kb flanking nucleotide sequences of chloroplast genomic DNA may be used. In some instances 0.5 to 1.5 kb flanking nucleotide sequences of nuclear genomic DNA may be used, or 2.0 to 5.0 kb may be used.

Compounds

The modified or transformed host organism disclosed herein is useful in the production of a desired biomolecule, compound, composition, or product; these terms can be used interchangeably. The present disclosure provides methods of producing, for example, an isoprenoid or isoprenoid precursor compound in a host cell. One such method involves, culturing a modified host cell in a suitable culture medium under conditions that promote synthesis of a product, for example, an isoprenoid compound or isoprenoid precursor compound, where the isoprenoid compound is generated by the expression of an enzyme of the present disclosure, wherein the enzyme uses a substrate present in the host cell. In some embodiments, a method further comprises isolating the isoprenoid compound from the cell and/or from the culture medium.

In some embodiments, the product (e.g. fuel molecule) is collected by harvesting the liquid medium. As some fuel molecules (e.g., monoterpenes) are immiscible in water, they would float to the surface of the liquid medium and could be extracted easily, for example by skimming. In other instances, the fuel molecules can be extracted from the liquid medium. In still other instances, the fuel molecules are volatile. In such instances, impermeable barriers can cover or otherwise surround the growth environment and can be extracted from the air within the barrier. For some fuel molecules, the product may be extracted from both the environment (e.g., liquid environment and/or air) and from the intact host cells. Typically, the organism would be harvested at an appropriate point and the product may then be extracted from the organism. The collection of cells may be by any means known in the art, including, but not limited to concentrating cells, mechanical or chemical disruption of cells, and purification of product(s) from cell cultures and/or cell lysates. Cells and/or organisms can be grown and then the product(s) collected by any means known to one of skill in the art. One method of extracting the product is by harvesting the host cell or a group of host cells and then drying the cell(s). The product(s) from the dried host cell(s) are then harvested by crushing the cells to expose the product. In some instances, the product may be produced without killing the organisms. Producing and/or expressing the product may not render the organism unviable.

In some embodiments, a genetically modified host cell is cultured in a suitable medium (e.g., Luria-Bertoni broth, optionally supplemented with one or more additional agents, such as an inducer (e.g., where the isoprenoid synthase is under the control of an inducible promoter); and the culture medium is overlaid with an organic solvent, e.g. dodecane, forming an organic layer. The compound produced by the genetically modified host partitions into the organic layer, from which it can then be purified. In some embodiments, where, for example, a prenyl transferase, isoprenoid synthase or mevalonate synthesis-encoding nucleotide sequence is operably linked to an inducible promoter, an inducer is added to the culture medium; and, after a suitable time, the compound is isolated from the organic layer overlaid on the culture medium.

In some embodiments, the compound or product, for example, an isoprenoid compound will be separated from other products which may be present in the organic layer. Separation of the compound from other products that may be present in the organic layer is readily achieved using, e.g., standard chromatographic techniques.

Methods of culturing the host cells, separating products, and isolating the desired product or products are known to one of skill in the art and are discussed further herein.

In some embodiments, the compound, for example, an isoprenoid or isoprenoid compound is produced in a genetically modified host cell at a level that is at least about 2-fold, at least about 5-fold, at least about 10-fold, at least about 25-fold, at least about 50-fold, at least about 100-fold, at least about 500-fold, at least about 1000-fold, at least about 2000-fold, at least about 3000-fold, at least about 4000-fold, at least about 5000-fold, or at least about 10,000-fold, or more, higher than the level of the isoprenoid or isoprenoid precursor compound produced in an unmodified host cell that produces the isoprenoid or isoprenoid precursor compound via the same biosynthetic pathway.

In some embodiments, the compound, for example, an isoprenoid compound is pure, e.g., at least about 40% pure, at least about 50% pure, at least about 60% pure, at least about 70% pure, at least about 80% pure, at least about 90% pure, at least about 95% pure, at least about 98%, or more than 98% pure. "Pure" in the context of an isoprenoid compound refers to an isoprenoid compound that is free from other isoprenoid compounds, portions of compounds, contaminants, and unwanted byproducts, for example.

Examples of products contemplated herein include hydrocarbon products and hydrocarbon derivative products. A hydrocarbon product is one that consists of only hydrogen molecules and carbon molecules. A hydrocarbon derivative product is a hydrocarbon product with one or more heteroatoms, wherein the heteroatom is any atom that is not hydrogen or carbon. Examples of heteroatoms include, but are not limited to, nitrogen, oxygen, sulfur, and phosphorus. Some products can be hydrocarbon-rich, wherein, for example, at least 50%, at least 60%, at least 70%, at least 80%, at least 90%, or at least 95% of the product by weight is made up of carbon and hydrogen.

One exemplary group of hydrocarbon products are isoprenoids. Isoprenoids (including terpenoids) are derived from isoprene subunits, but are modified, for example, by the addition of heteroatoms such as oxygen, by carbon skeleton rearrangement, and by alkylation. Isoprenoids generally have a number of carbon atoms which is evenly divisible by five, but this is not a requirement as "irregular" terpenoids are known to one of skill in the art, Carotenoids, such as carotenes and xanthophylls, are examples of isoprenoids that are useful products. A steroid is an example of a terpenoid. Examples of isoprenoids include, but are not limited to, hemiterpenes (C5), monoterpenes (C10), sesquiterpenes (C15), diterpenes (C20), triterpenes (C30), tetraterpenes (C40), polyterpenes ($C_n$, wherein "n" is equal to or greater than 45), and their derivatives. Other examples of isoprenoids include, but are not limited to, limonene, 1,8-cineole, α-pinene, camphene, (+)-sabinene, myrcene, abietadiene, taxadiene, farnesyl pyrophosphate, fusicoccadiene, amorphadiene, (E)-α-bisabolene, zingiberene, or diapophytoene, and their derivatives.

Products, for example fuel products, comprising hydrocarbons, may be precursors or products conventionally derived from crude oil, or petroleum, such as, but not limited to, liquid petroleum gas, naptha (ligroin), gasoline, kerosene, diesel, lubricating oil, heavy gas, coke, asphalt, tar, and waxes.

Useful products include, but are not limited to, terpenes and terpenoids as described above. An exemplary group of terpenes are diterpenes (C20), Diterpenes are hydrocarbons that can be modified (e.g. oxidized, methyl groups removed, or cyclized); the carbon skeleton of a diterpene can be rearranged, to form, for example, terpenoids, such as fusicoccadiene. Fusicoccadiene may also be formed, for example, directly from the isoprene precursors, without being bound by the availability of diterpene or GGDP. Genetic modification of organisms, such as algae, by the methods described herein, can lead to the production of fusicoccadiene, for example, and other types of terpenes, such as limonene, for example. Genetic modification can also lead to the production of modified terpenes, such as methyl squalene or hydroxylated and/or conjugated terpenes such as paclitaxel.

Other useful products can be, for example, a product comprising a hydrocarbon obtained from an organism expressing a diterpene synthase. Such exemplary products include ent-kaurene, casbene, and fusicoccadiene, and may also include fuel additives.

In some embodiments, a product (such as a fuel product) contemplated herein comprises one or more carbons derived from an inorganic carbon source. In some embodiments, at least 10%, at least 20%, at least 30%, at least 40%, at least 50%, at least 60%, at least 70%, at least 80%, at least 90%, at least 95%, or at least 99% of the carbons of a product as described herein are derived from an inorganic carbon source. Examples of inorganic carbon sources include, but are not limited to, carbon dioxide, carbonate, bicarbonate, and carbonic acid. The product can be, for example, an organic molecule with carbons from an inorganic carbon source that were fixed during photosynthesis.

The products produced by the present disclosure may be naturally, or non-naturally (e.g., as a result of transformation) produced by the host cell(s) and/or organism(s) transformed. For example, products not naturally produced by algae may include non-native terpenes/terpenoids such as fusicoccadiene or limonene. A product naturally produced in algae may be a terpene such as a carotenoid (for example, beta-carotene). The host cell may be genetically modified, for example, by transformation of the cell with a sequence encoding a protein, wherein expression of the protein results in the secretion of a naturally or a non-naturally produced product or products. The product may be a molecule not found in nature.

Examples of products include petrochemical products, precursors of petrochemical products, fuel products, petroleum products, precursors of petroleum products, and all other substances that may be useful in the petrochemical industry. The product may be used for generating substances, or materials, useful in the petrochemical industry. The products may be used in a combustor such as a boiler, kiln, dryer or furnace. Other examples of combustors are internal combustion engines such as vehicle engines or generators, including gasoline engines, diesel engines, jet engines, and other types of engines. In one embodiment, a method herein comprises combusting a refined or "upgraded" composition. For example, combusting a refined composition can comprise inserting the refined composition into a combustion engine, such as an automobile engine or a jet engine. Products described herein may also be used to produce plastics, resins, fibers, elastomers, pharmaceuticals, neutraceuticals, lubricants, and gels, for example.

Useful products can also include isoprenoid precursors. Isoprenoid precursors are generated by one of two pathways; the mevalonate pathway or the methylerythritol phosphate (MEP) pathway. Both pathways generate dimethylallyl pyrophosphate (DMAPP) and isopentyl pyrophosphate (IPP), the common C5 precursor for isoprenoids. The DMAPP and IPP are condensed to form geranyl-diphosphate (GPP), or other precursors, such as farnesyl-diphosphate (FPP) or geranylgeranyl-diphosphate (GGPP), from which higher isoprenoids are formed.

Useful products can also include small alkanes (for example, 1 to approximately 4 carbons) such as methane, ethane, propane, or butane, which may be used for heating (such as in cooking) or making plastics. Products may also include molecules with a carbon backbone of approximately 5 to approximately 9 carbon atoms, such as naptha or ligroin, or their precursors. Other products may include molecules with a carbon background of about 5 to about 12 carbon atoms, or cycloalkanes used as gasoline or motor fuel. Molecules and aromatics of approximately 10 to approximately 18 carbons, such as kerosene, or its precursors, may also be useful as products. Other products include lubricating oil, heavy gas oil, or fuel oil, or their precursors, and can contain alkanes, cycloalkanes, or aromatics of approximately 12 to approximately 70 carbons. Products also include other residuals that can be derived from or found in crude oil, such as coke, asphalt, tar, and waxes, generally containing multiple rings with about 70 or more carbons, and their precursors.

Modified organisms can be grown, in some embodiments in the presence of $CO_2$, to produce a desired polypeptide. In some embodiments, the products produced by the modified organism are isolated or collected. Collected products, such as terpenes and terpenoids, may then be further modified, for example, by refining and/or cracking to produce fuel molecules or components.

The various products may be further refined to a final product for an end user by a number of processes. Refining can, for example, occur by fractional distillation. For example, a mixture of products, such as a mix of different hydrocarbons with various chain lengths may be separated into various components by fractional distillation.

Refining may also include any one or more of the following steps, cracking, unifying, or altering the product. Large products, such as large hydrocarbons (e.g. $\geq C10$), may be broken down into smaller fragments by cracking. Cracking may be performed by heat or high pressure, such as by steam, visbreaking, or coking. Products may also be refined by visbreaking, for example by thermally cracking large hydrocarbon molecules in the product by heating the product in a furnace. Refining may also include coking, wherein a heavy, almost pure carbon residue is produced. Cracking may also be performed by catalytic means to enhance the rate of the cracking reaction by using catalysts such as, but not limited to, zeolite, aluminum hydrosilicate, bauxite, or silica-alumina. Catalysis may be by fluid catalytic cracking, whereby a hot catalyst, such as zeolite, is used to catalyze cracking reactions. Catalysis may also be performed by hydrocracking, where lower temperatures are generally used in comparison to fluid catalytic cracking. Hydrocracking can occur in the presence of elevated partial pressure of hydrogen gas. Products may be refined by catalytic cracking to generate diesel, gasoline, and/or kerosene, The products may also be refined by combining them in a unification step, for example by using catalysts, such as platinum or a platinum-rhenium mix. The unification process can produce hydrogen gas, a by-product, which may be used in cracking.

The products may also be refined by altering, rearranging, or restructuring hydrocarbons into smaller molecules. There are a number of chemical reactions that occur in catalytic reforming processes which are known to one of ordinary skill in the arts, Catalytic reforming can be performed in the presence of a catalyst and a high partial pressure of hydrogen. One common process is alkylation. For example, propylene and butylene are mixed with a catalyst such as hydrofluoric acid or sulfuric acid, and the resulting products are high octane hydrocarbons, which can be used to reduce knocking in gasoline blends.

The products may also be blended or combined into mixtures to obtain an end product. For example, the products may be blended to form gasoline of various grades, gasoline with or without additives, lubricating oils of various weights and grades, kerosene of various grades, jet fuel, diesel fuel, heating oil, and chemicals for making plastics and other polymers. Compositions of the products described herein may be combined or blended with fuel products produced by other means.

Some products produced from the host cells of the disclosure, especially after refining, will be identical to existing petrochemicals, i.e. contain the same chemical structure. For instance, crude oil contains the isoprenoid pristane, which is thought to be a breakdown product of phytol, which is a component of chlorophyll. Some of the products may not be the same as existing petrochemicals. However, although a molecule may not exist in conventional petrochemicals or refining, it may still be useful in these industries. For example, a hydrocarbon could be produced that is in the boiling point range of gasoline, and that could be used as gasoline or an additive, even though the hydrocarbon does not normally occur in gasoline.

A product herein can be described by its Carbon Isotope Distribution (CID). At the molecular level, a CID is the statistical likelihood of a single carbon atom within a molecule to be one of the naturally occurring carbon isotopes (for example, $^{12}C$, $^{13}C$, or $^{14}C$). At the bulk level of a product, a CID may be the relative abundance of naturally occurring carbon isotopes (for example, $^{12}C$, $^{13}C$, or $^{14}C$) in a compound containing at least one carbon atom. It is noted that the CID of a fossil fuel may differ based on its source. For example, with CID(fos), the CID of carbon in a fossil fuel, such as petroleum, natural gas, and coal is distinguishable from the CID(atm), the CID of carbon in current atmospheric carbon dioxide. Additionally, the CID(photo-atm) refers to the CID of a carbon-based compound made by photosynthesis in recent history where the source of inorganic carbon was carbon dioxide in the atmosphere. Also, CID(photo-fos) refers to the CID of a carbon based compound made by photosynthesis in recent history where the source of substantially all of the inorganic carbon was carbon dioxide produced by the burning of fossil fuels (for example, coal, natural gas, and/or petroleum). The exact distribution is also a characteristic of 1) the type of photosynthetic organism that produced the molecule, and 2) the source of inorganic carbon. These isotope distributions can be used to define the composition of photosynthetically-derived fuel products. Carbon isotopes are unevenly distributed among and within different compounds and the isotopic distribution can reveal information about the physical, chemical, and metabolic processes involved in carbon transformation. The overall abundance of $^{13}C$ relative to $^{12}C$ in a photosynthetic organism is often less than the overall abundance of $^{13}C$ relative to $^{12}C$ in atmospheric carbon dioxide, indicating that carbon isotope discrimination occurs in the incorporation of carbon dioxide into photosynthetic biomass.

A product, either before or after refining, can be identical to an existing petrochemical. Some of the fuel products may not be the same as existing petrochemicals. In one embodiment, a fuel product is similar to an existing petrochemical, except for the carbon isotope distribution. For example, it is believed that no fossil fuel petrochemicals have a $\delta^{13}C$ distribution of less than −32‰, whereas fuel products as described herein can have a $\delta^{13}C$ distribution of less than −32‰, less than −35‰, less than −40‰, less than −45‰, less than −50‰, less than −55‰, or less than −60‰. In another embodiment, a fuel product or composition is similar but not the same as an existing fossil fuel petrochemical and has a $\delta^{13}C$ distribution of less than −32‰, less than −35‰ less than −40‰, less than −45‰, less than −50‰, less than −55‰ or less than −60‰.

A fuel product can be a composition comprising, for example, hydrogen and carbon molecules, wherein the hydrogen and carbon molecules are at least about 80% of the atomic weight of the composition, and wherein the $\delta^{13}C$ distribution of the composition is less than about −32‰. For some fuel products described herein, the hydrogen and carbon molecules are at least 90% of the atomic weight of the composition. For example, a biodiesel or fatty acid methyl ester (which has less than 90% hydrogen and carbon molecules by weight) may not be part of the composition. In still other compositions, the hydrogen and carbon molecules are at least 95 or at least 99% of the atomic weight of the composition. In yet other compositions, the hydrogen and carbon molecules are 100% of the atomic weight of the composition. In some embodiments, the composition is a liquid. In other embodiments, the composition is a fuel additive or a fuel product.

Also described herein is a fuel product comprising a composition comprising: hydrogen and carbon molecules, wherein the hydrogen and carbon molecules are at least 80% of the atomic weight of the composition, and wherein the $\delta^{13}C$ distribution of the composition is less than −32‰; and a fuel component. In some embodiments, the $\delta^{13}C$ distribution of the composition is less than about −35‰, less than about −40‰, less than about −45‰, less than about −50‰, less than about −55‰, or less than about −60‰. In some embodiments, the fuel component of the composition is a blending fuel, for example, a fossil fuel, gasoline, diesel, ethanol, jet fuel, or any combination thereof. In still other embodiments, the blending fuel has a $\delta^{13}C$ distribution of greater than −32‰. For some fuel products described herein, the fuel component is a fuel additive which may be MTBE, an anti-oxidant, an antistatic agent, a corrosion inhibitor, or any combination thereof. A fuel product as described herein may be a product generated by blending a fuel product as described and a fuel component. In some embodiments, the fuel product has a $\delta^{13}C$ distribution of greater than −32‰. In other embodiments, the fuel product has a $\delta^{13}C$ distribution of less than −32‰. For example, an oil composition extracted from an organism can be blended with a fuel component prior to refining (for example, cracking) in order to generate a fuel product as described herein. A fuel component, can be a fossil fuel, or a mixing blend for generating a fuel product. For example, a mixture for fuel blending may be a hydrocarbon mixture that is suitable for blending with another hydrocarbon mixture to generate a fuel product. For example, a mixture of light alkanes may not have a certain octane number to be suitable for a type of fuel, however, it can be blended with a high octane mixture to generate a fuel product. In another example, a composition with a $\delta^{13}C$ distribution of less than −32‰ is blended with a hydrocarbon mixture for fuel blending to create a fuel product. In some embodiments, the composition or fuel component alone are not suitable as a fuel product, however, when combined, they are useful as a fuel product. In other embodiments, either the composition or the fuel component or both individually are suitable as a fuel product., in yet another embodiment, the fuel component is an existing petroleum product, such as gasoline or jet fuel. In other embodiments, the fuel component is derived from a renewable resource, such as bioethanol, biodiesel, and biogasoline.

Oil compositions, derived from biomass obtained from a host cell, can be used for producing high-octane hydrocarbon products. Thus, one embodiment describes a method of forming a fuel product, comprising: obtaining an upgraded oil composition, cracking the oil composition, and blending the resulting one or more light hydrocarbons, having 4 to 12 carbons and an Octane number of 80 or higher, with a hydrocarbon having an Octane number of 80 or less. The hydrocarbons having an Octane number of 80 or less are, for example, fossil fuels derived from refining crude oil.

The biomass feedstock obtained from a host organism can be modified or tagged such that the light hydrocarbon products can be identified or traced back to their original feedstock. For example, carbon isotopes can be introduced into a biomass hydrocarbon in the course of its biosynthesis. The tagged hydrocarbon feedstock can be subjected to the refining processes described herein to produce a light hydrocarbon product tagged with a carbon isotope. The isotopes allow for the identification of the tagged products, either alone or in combination with other untagged products, such that the tagged products can be traced back to their original biomass feedstocks.

TABLE A

Examples of Enzymes Involved in the Isoprenoid Pathway

| Synthase | Source | NCBI protein ID |
| --- | --- | --- |
| Limonene | M. spicata | 2ONH_A |
| Cineole | S. officinalis | AAC26016 |
| Pinene | A. grandis | AAK83564 |
| Camphene | A. grandis | AAB70707 |
| Sabinene | S. officinalis | AAC26018 |
| Myrcene | A. grandis | AAB71084 |
| Abietadiene | A. grandis | Q38710 |
| Taxadiene | T. brevifolia | AAK83566 |
| FPP | G. gallus | P08836 |
| Amorphadiene | A. annua | AAF61439 |
| Bisabolene | A. grandis | O81086 |
| Diapophytoene | S. aureus | |
| Diapophytoene desaturase | S. aureus | |
| GPPS-LSU | M. spicata | AAF08793 |
| GPPS-SSU | M. spicata | AAF08792 |
| GPPS | A. thaliana | CAC16849 |
| GPPS | C. reinhardtii | EDP05515 |
| FPP | E. coli | NP_414955 |
| FPP | A. thaliana | NP_199588 |
| FPP | A. thaliana | NP_193452 |
| FPP | C. reinhardtii | EDP03194 |
| IPP isomerase | E. coli | NP_417365 |
| IPP isomerase | H. pluvialis | ABB80114 |
| Limonene | L. angustifolia | ABB73044 |
| Monoterpene | S. lycopersicum | AAX69064 |
| Terpinolene | O. basilicum | AAV63792 |
| Myrcene | O. basilicum | AAV63791 |
| Zingiberene | O. basilicum | AAV63788 |
| Myrcene | Q. ilex | CAC41012 |
| Myrcene | P. abies | AAS47696 |
| Myrcene, ocimene | A. thaliana | NP_179998 |
| Myrcene, ocimene | A. thaliana | NP_567511 |
| Sesquiterpene | Z. mays; B73 | AAS88571 |
| Sesquiterpene | A. thaliana | NP_199276 |
| Sesquiterpene | A. thaliana | NP_193064 |
| Sesquiterpene | A. thaliana | NP_193066 |
| Curcumene | P. cablin | AAS86319 |
| Farnesene | M. domestica | AAX19772 |
| Farnesene | C. sativus | AAU05951 |
| Farnesene | C. junos | AAK54279 |
| Farnesene | P. abies | AAS47697 |
| Bisabolene | P. abies | AAS47689 |

TABLE A-continued

Examples of Enzymes Involved in the Isoprenoid Pathway

| Synthase | Source | NCBI protein ID |
|---|---|---|
| Sesquiterpene | A. thaliana | NP_197784 |
| Sesquiterpene | A. thailana | NP_175313 |
| GPP Chimera | | |
| GPPS-LSU + SSU fusion | | |
| Geranylgeranyl reductase | A. thaliana | NP_177587 |
| Geranylgeranyl reductase | C. reinhardtii | EDP09986 |
| Chlorophyllidohydrolase | C. reinhardtii | EDP01364 |
| Chlorophyllidohydrolase | A. thaliana | NP_564094 |
| Chlorophyllidohydrolase | A. thaliana | NP_199199 |
| Phosphatase | S. cerevisiae | AAB64930 |
| FPP A118W | G. gallus | |

Codon Optimization

As discussed above, one or more codons of an encoding polynucleotide can be "biased" or "optimized" to reflect the codon usage of the host organism. For example, one or more codons of an encoding polynucleotide can be "biased" or "optimized" to reflect chloroplast codon usage (Table B) or nuclear codon usage (Table C). Most amino acids are encoded by two or more different (degenerate) codons, and it is well recognized that various organisms utilize certain codons in preference to others. "Biased" or codon "optimized" can be used interchangeably throughout the specification. Codon bias can be variously skewed in different plants, including, for example, in alga as compared to tobacco. Generally, the codon bias selected reflects codon usage of the plant (or organelle therein) which is being transformed with the nucleic acids of the present disclosure.

A polynucleotide that is biased for a particular codon usage can be synthesized de novo, or can be genetically modified using routine recombinant DNA techniques, for example, by a site directed mutagenesis method, to change one or more codons such that they are biased for chloroplast codon usage.

Such preferential codon usage, which is utilized in chloroplasts, is referred to herein as "chloroplast codon usage." Table B (below) shows the chloroplast codon usage for *C. reinhardtii* (see U.S. Patent Application Publication No.: 2004/0014174, published Jan. 22, 2004).

primer that is mismatched for the nucleotide(s) to be changed such that the amplification product is biased to reflect chloroplast codon usage, or can be the de novo synthesis of polynucleotide sequence such that the change (bias) is introduced as a consequence of the synthesis procedure.

In addition to utilizing chloroplast codon bias as a means to provide efficient translation of a polypeptide, it will be recognized that an alternative means for obtaining efficient translation of a polypeptide in a chloroplast is to re-engineer the chloroplast genome (e.g., a *C. reinhardtii* chloroplast genome) for the expression of tRNAs not otherwise expressed in the chloroplast genome. Such an engineered algae expressing one or more exogenous tRNA molecules provides the advantage that it would obviate a requirement to modify every polynucleotide of interest that is to be introduced into and expressed from a chloroplast genome; instead, algae such as *C. reinhardtii* that comprise a genetically modified chloroplast genome can be provided and utilized for efficient translation of a polypeptide according to any method of the disclosure. Correlations between tRNA abundance and codon usage in highly expressed genes is well known (for example, as described in Franklin et al., Plant J. 30:733-744, 2002; Dong et al., J. Mol. Biol. 260:649-663, 1996; Duret, Trends Genet. 16:287-289, 2000; Goldman et. al., J. Mol. Biol. 245:467-473, 1995; and Komar et. al., Biol. Chem. 379:1295-1300, 1998). In *E. coli*, for example, re-engineering of strains to express underutilized tRNAs resulted in enhanced expression of genes which utilize these codons (see Novy et al., in Novations 12:1-3, 2001). Utilizing endogenous tRNA genes, site directed mutagenesis can be used to make a synthetic tRNA gene, which can be introduced into chloroplasts to complement rare or unused tRNA genes in a chloroplast genome, such as a *C. reinhardtii* chloroplast genome.

Generally, the chloroplast codon bias selected for purposes of the present disclosure, including, for example, in preparing a synthetic polynucleotide as disclosed herein reflects chloroplast codon usage of a plant chloroplast, and includes a codon bias that, with respect to the third position of a codon, is skewed towards A/T, for example, where the third position has greater than about 66% AT bias, or greater than about 70%

TABLE B

Chloroplast Codon Usage in *Chlamydomonas reinhardtii*

| | | | |
|---|---|---|---|
| UUU 34.1* (348**) | UCU 19.4 (198) | UAU 23.7 (242) | UGU 8.5 (87) |
| UUC 14.2 (145) | UCC 4.9 (50) | UAC 10.4 (106) | UGC 2.6 (27) |
| UUA 72.8 (742) | UCA 20.4 (208) | UAA 2.7 (28) | UGA 0.1 (1) |
| UUG 5.6 (57) | UCG 5.2 (53) | UAG 0.7 (7) | UGG 13.7 (140) |
| CUU 14.8 (151) | CCU 14.9 (152) | CAU 11.1 (113) | CGU 25.5 (260) |
| CUC 1.0 (10) | CCC 5.4 (55) | CAC 8.4 (86) | CGC 5.1 (52) |
| CUA 6.8 (69) | CCA 19.3 (197) | CAA 34.8 (355) | CGA 3.8 (39) |
| CUG 7.2 (73) | CCG 3.0 (31) | CAG 5.4 (55) | CGG 0.5 (5) |
| AUU 44.6 (455) | ACU 23.3 (237) | AAU 44.0 (449) | AGU 16.9 (172) |
| AUC 9.7 (99) | ACC 7.8 (80) | AAC 19.7 (201) | AGC 6.7 (68) |
| AUA 8.2 (84) | ACA 29.3 (299) | AAA 61.5 (627) | AGA 5.0 (51) |
| AUG 23.3 (238) | ACG 4.2 (43) | AAG 11.0 (112) | AGG 1.5 (15) |
| GUU 27.5 (280) | GCU 30.6 (312) | GAU 23.8 (243) | GGU 40.0 (408) |
| GUC 4.6 (47) | GCC 11.1 (113) | GAC 11.6 (118) | GGC 8.7 (89) |
| GUA 26.4 (269) | GCA 19.9 (203) | GAA 40.3 (411) | GGA 9.6 (98) |
| GUG 7.1 (72) | GCG 4.3 (44) | GAG 6.9 (70) | GGG 4.3 (44) |

*Frequency of codon usage per 1,000 codons.
**Number of times observed in 36 chloroplast coding sequences (10,193 codons).

The chloroplast codon bias can, but need not, be selected based on a particular organism in which a synthetic polynucleotide is to be expressed. The manipulation can be a change to a codon, for example, by a method such as site directed mutagenesis, by a method such as PCR using a AT bias. In one embodiment, the chloroplast codon usage is biased to reflect alga chloroplast codon usage, for example, *C. reinhardtii*, which has about 74.6% AT bias in the third codon position. Preferred codon usage in the chloroplasts of algae has been described in US 2004/0014174.

Table C exemplifies codons that are preferentially used in algal nuclear genes. The nuclear codon bias can, but need not, be selected based on a particular organism in which a synthetic polynucleotide is to be expressed. The manipulation can be a change to a codon, for example, by a method such as site directed mutagenesis, by a method such as PCR using a primer that is mismatched for the nucleotide(s) to be changed such that the amplification product is biased to reflect nuclear codon usage, or can be the de novo synthesis of polynucleotide sequence such that the change (bias) is introduced as a consequence of the synthesis procedure.

In addition to utilizing nuclear codon bias as a means to provide efficient translation of a polypeptide, it will be recognized that an alternative means for obtaining efficient translation of a polypeptide in a nucleus is to re-engineer the nuclear genome (e.g., a C. reinhardtii nuclear genome) for the expression of tRNAs not otherwise expressed in the nuclear genome. Such an engineered algae expressing one or more exogenous tRNA molecules provides the advantage that it would obviate a requirement to modify every polynucleotide of interest that is to be introduced into and expressed from a nuclear genome; instead, algae such as C. reinhardtii that comprise a genetically modified nuclear genome can be provided and utilized for efficient translation of a polypeptide according to any method of the disclosure. Correlations between tRNA abundance and codon usage in highly expressed genes is well known (for example, as described in Franklin et al., Plant J. 30:733-744, 2002; Dong et al., J. Mol. Biol. 260:649-663, 1996; Duret, Trends Genet. 16:287-289, 2000; Goldman et. Al., J. Mol. Biol. 245:467-473, 1995; and Komar et. Al., Biol. Chem. 379:1295-1300, 1998). In *E. coli*, for example, re-engineering of strains to express underutilized tRNAs resulted in enhanced expression of genes which utilize these codons (see Novy et al., in Novations 12:1-3, 2001). Utilizing endogenous tRNA genes, site directed mutagenesis can be used to make a synthetic tRNA gene, which can be introduced into the nucleus to complement rare or unused tRNA genes in a nuclear genome, such as a *C. reinhardtii* nuclear genome.

Generally, the nuclear codon bias selected for purposes of the present disclosure, including, for example, in preparing a synthetic polynucleotide as disclosed herein, can reflect nuclear codon usage of an algal nucleus and includes a codon bias that results in the coding sequence containing greater than 60% G/C content.

Table D lists the codon selected at each position for back-translating the protein to a DNA sequence for synthesis. The selected codon is the sequence recognized by the tRNA encoded in the chloroplast genome when present; the stop codon (TAA) is the codon most frequently present in the chloroplast encoded genes. If an undesired restriction site is created, the next best choice according to the regular *Chlamydomonas* chloroplast usage table that eliminates the restriction site is selected.

TABLE D

| Amino acid | Codon utilized |
|---|---|
| F | TTC |
| L | TTA |
| I | ATC |
| V | GTA |
| S | TCA |
| P | CCA |
| T | ACA |
| A | GCA |
| Y | TAC |
| H | CAC |
| Q | CAA |
| N | AAC |
| K | AAA |
| D | GAC |
| E | GAA |
| C | TGC |
| R | CGT |
| G | GGC |
| W | TGG |
| M | ATG |
| STOP | TAA |

Percent Sequence Identity

One example of an algorithm that is suitable for determining percent sequence identity or sequence similarity between nucleic acid or polypeptide sequences is the BLAST algorithm, which is described, e.g., in Altschul et al., *J. Mol. Biol.* 215:403-410 (1990). Software for performing BLAST analysis is publicly available through the National Center for Biotechnology Information. The BLAST algorithm parameters W, T, and X determine the sensitivity and speed of the alignment. The BLASTN program (for nucleotide sequences) uses as defaults a word length (W) of 11, an expectation (E) of 10, a cutoff of 100, M=5, N=4, and a comparison of both strands. For amino acid sequences, the BLASTP program uses as

TABLE C fields: [triplet] [frequency: per thousand] ([number])
Coding GC 66.30% 1$^{st}$ letter GC 64.80% 2$^{nd}$ letter GC 47.90%
3$^{rd}$ letter GC 86.21%
Nuclear Codon Usage in *Chlamydomonas reinhardtii*

| | | | |
|---|---|---|---|
| UUU 5.0 (2110) | UCU 4.7 (1992) | UAU 2.6 (1085) | UGU 1.4 (601) |
| UUC 27.1 (11411) | UCC 16.1 (6782) | UAC 22.8 (9579) | UGC 13.1 (5498) |
| UUA 0.6 (247) | UCA 3.2 (1348) | UAA 1.0 (441) | UGA 0.5 (227) |
| UUG 4.0 (1673) | UCG 16.1 (6763) | UAG 0.4 (183) | UGG 13.2 (5559) |
| CUU 4.4 (1869) | CCU 8.1 (3416) | CAU 2.2 (919) | CGU 4.9 (2071) |
| CUC 13.0 (5480) | CCC 29.5 (12409) | CAC 17.2 (7252) | CGC 34.9 (14676) |
| CUA 2.6 (1086) | CCA 5.1 (2124) | CAA 4.2 (1780) | CGA 2.0 (841) |
| CUG 65.2 (27420) | CCG 20.7 (8684) | CAG 36.3 (15283) | CGG 11.2 (4711) |
| AUU 8.0 (3360) | ACU 5.2 (2171) | AAU 2.8 (1157) | AGU 2.6 (1089) |
| AUC 26.6 (11200) | ACC 27.7 (11663) | AAC 28.5 (11977) | AGC 22.8 (9590) |
| AUA 1.1 (443) | ACA 4.1 (1713) | AAA 2.4 (1028) | AGA 0.7 (287) |
| 0AUG 25.7 (10796) | ACG 15.9 (6684) | AAG 43.3 (18212) | AGG 2.7 (1150) |
| GUU 5.1 (2158) | GCU 16.7 (7030) | GAU 6.7 (2805) | GGU 9.5 (3984) |
| GUC 15.4 (6496) | GCC 54.6 (22960) | GAC 41.7 (17519) | GGC 62.0 (26064) |
| GUA 2.0 (857) | GCA 10.6 (4467) | GAA 2.8 (1172) | GGA 5.0 (2084) |
| GUG 46.5 (19558) | GCG 44.4 (18688) | GAG 53.5 (22486) | GGG 9.7 (4087) | defaults a word length (W) of 3, an expectation (E) of 10, and the BLOSUM62 scoring matrix (as described, for example, in Henikoff & Henikoff (1989) *Proc. Natl. Acad. Sci. USA*, 89:10915). In addition to calculating percent sequence identity, the BLAST algorithm also can perform a statistical analysis of the similarity between two sequences (for example, as described in Karlin & Altschul, *Proc. Nat'l. Acad. Sci. USA*, 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, less than about 0.01, or less than about 0.001.

Fatty Acids and Glycerol Lipids

The present disclosure describes host cells capable of making polypeptides that contribute to the accumulation and/or secretion of fatty acids, glycerol lipids, or oils, by transforming host cells (e.g., alga cells such as *C. reinhardtii, D. salina, H. pluvalis*, and cyanobacterial cells) with nucleic acids encoding one or more different enzymes. Examples of such enzymes include acetyl-CoA carboxylase, ketoreductase, thioesterase, malonyltransferase, dehydratase, acyl-CoA ligase, ketoacylsynthase, enoylreductase, and desaturase. The enzymes can be, for example, catabolic or biodegrading enzymes.

In some instances, the host cell will naturally produce the fatty acid, glycerol lipid, triglyceride, or oil of interest. Therefore, transformation of the host cell with a polynucleotide encoding an enzyme, for example an ACCase, will allow for the increased activity of the enzyme and/or increased accumulation and/or secretion of a molecule of interest (e.g., a lipid) in the cell.

A change in the accumulation and/or secretion of a desired product, for example, fatty acids, glycerol lipids, or oils, by a transformed host cell can include, for example, a change in the total oil content over that normally present in the cell, or a change in the type of oil that is normally present in the cell.

Some host cells may be transformed with multiple genes encoding one or more enzymes. For example, a single transformed cell may contain exogenous nucleic acids encoding enzymes that make up an entire glycerolipid synthesis pathway. One example of a pathway might include genes encoding an acetyl CoA carboxylase, a malonyltransferase, a ketoacylsynthase, and a thioesterase. Cells transformed with an entire pathway and/or enzymes extracted from those cells, can synthesize, for example, complete fatty acids or intermediates of the fatty acid synthesis pathway. Constructs may contain, for example, multiple copies of the same gene, multiple genes encoding the same enzyme from different organisms, and/or multiple genes with one or more mutations in the coding sequence(s).

The enzyme(s) produced by the modified cells may result in the production of fatty acids, glycerol lipids, triglycerides, or oils that may be collected from the cells and, or the surrounding environment (e.g., bioreactor or growth medium). In some embodiments, the collection of the fatty acids, glycerol lipids, triglycerides, or oils is performed after the product is secreted from the cell via a cell membrane transporter.

Examples of candidate *Chlamydomonas* genes encoding enzymes of glycerolipid metabolism that can be used in the described embodiments are described in The *Chlamydomonas* Sourcebook Second Edition, Organellar and Metabolic Processes, Vol. 2, pp. 41-68, David B. Stern (Ed.), (2009), Elsevier Academic Press.

For example, enzymes involved in plastid, mitochondrial, and cytosolic pathways, along with plastidic and cytosolic isoforms of fatty acid desaturases, and triglyceride synthesis enzymes are described (and their accession numbers provided). An exemplary chart of some of the genes described is provided below:

| Acyl-ACP thioesterase | FAT1 | EDP08596 |
| Long-chain acyl-CoA synthetase | LCS1 | EDO96800 |
| CDP-DAG: Inositol phosphotransferase | PIS1 | EDP06395 |
| Acyl-CoA: Diacylglycerol acyltransferase | DGA1 | EDO96893 |
| Phospholipid: Diacylglycerol acyltransferase | LRO1(LCA1) | EDP07444 |

Examples of the types of fatty acids and/or glycerol lipids that a host cell or organism can produce, are described below.

Lipids are a broad group of naturally occurring molecules which includes fats, waxes, sterols, fat-soluble vitamins (such as vitamins A, D, E and K), monoglycerides, diglycerides, phospholipids, and others. The main biological functions of lipids include energy storage, as structural components of cell membranes, and as important signaling molecules.

Lipids may be broadly defined as hydrophobic or amphiphilic small molecules; the amphiphilic nature of some lipids allows them to form structures such as vesicles, liposomes, or membranes in an aqueous environment. Biological lipids originate entirely or in part from two distinct types of biochemical subunits or "building blocks": ketoacyl and isoprene groups. Lipids may be divided into eight categories: fatty acyls, glycerolipids, glycerophospholipids, sphingolipids, saccharolipids and polyketides (derived from condensation of ketoacyl subunits); and sterol lipids and prenol lipids (derived from condensation of isoprene subunits). For this disclosure, saccharolipids will not be discussed.

Fats are a subgroup of lipids called triglycerides. Lipids also encompass molecules such as fatty acids and their derivatives (including tri-, di-, and monoglycerides and phospholipids), as well as other sterol-containing metabolites such as cholesterol. Humans and other mammals use various biosynthetic pathways to both break down and synthesize lipids.

Fatty Acyls

Fatty acyls, a generic term for describing fatty acids, their conjugates and derivatives, are a diverse group of molecules synthesized by chain-elongation of an acetyl-CoA primer with malonyl-CoA or methylmalonyl-CoA groups in a process called fatty acid synthesis. A fatty acid is any of the aliphatic monocarboxylic acids that can be liberated by hydrolysis from naturally occurring fats and oils. They are made of a hydrocarbon chain that terminates with a carboxylic acid group; this arrangement confers the molecule with a polar, hydrophilic end, and a nonpolar, hydrophobic end that is insoluble in water. The fatty acid structure is one of the most fundamental categories of biological lipids, and is commonly used as a building block of more structurally complex lipids. The carbon chain, typically between four to 24 carbons long, may be saturated or unsaturated, and may be attached to functional groups containing oxygen, halogens, nitrogen and sulfur; branched fatty acids and hydroxyl fatty acids also occur, and very long chain acids of over 30 carbons are found in waxes. Where a double bond exists, there is the possibility of either a cis or trans geometric isomerism, which significantly affects the molecule's molecular configuration. Cis-double bonds cause the fatty acid chain to bend, an effect that is more pronounced the more double bonds there are in a chain. This in turn plays an important role in the structure and function of cell membranes. Most naturally occurring fatty acids are of the cis configuration, although the trans form does exist in some natural and partially hydrogenated fats and oils.

Examples of biologically important fatty acids are the eicosanoids, derived primarily from arachidonic acid and eicosapentaenoic acid, which include prostaglandins, leukotrienes, and thromboxanes. Other major lipid classes in the fatty acid category are the fatty esters and fatty amides. Fatty esters include important biochemical intermediates such as wax esters, fatty acid thioester coenzyme A derivatives, fatty acid thioester ACP derivatives and fatty acid carnitines. The fatty amides include N-acyl ethanolamines.

Glycerolipids

Glycerolipids are composed mainly of mono-, di- and tri-substituted glycerols, the most well-known being the fatty acid esters of glycerol (triacylglycerols), also known as triglycerides. In these compounds, the three hydroxyl groups of glycerol are each esterified, usually by different fatty acids. Because they function as a food store, these lipids comprise the bulk of storage fat in animal tissues. The hydrolysis of the ester bonds of triacylglycerols and the release of glycerol and fatty acids from adipose tissue is called fat mobilization.

Additional subclasses of glycerolipids are represented by glycosylglycerols, which are characterized by the presence of one or more sugar residues attached to glycerol via a glycosidic linkage. An example of a structure in this category is the digalactosyldiacylglycerols found in plant membranes.

Exemplary *Chlamydomonas* glycerolipids include: DGDG, digalactosyldiacylglycerol; DGTS, diacylglyceryl-N,N,N-trimethylhomoserine; MGDG, monogalactosyldiacylglycerol; PtdEtn, phosphatidylethanolamine; PtdGro, phosphatidylglycerol; PtdIns, phosphatidylinositol; SQDG, sulfoquinovosyldiacylglycerol; and TAG, triacylglycerol.

Glycerophospholipids

Glycerophospholipids are any derivative of glycerophosphoric acid that contains at least one O-acyl, O-alkyl, or O-alkenyl group attached to the glycerol residue. The common glycerophospholipids are named as derivatives of phosphatidic acid (phosphatidyl choline, phosphatidyl serine, and phosphatidyl ethanolamine).

Glycerophospholipids, also referred to as phospholipids, are ubiquitous in nature and are key components of the lipid bilayer of cells, as well as being involved in metabolism and cell signaling. Glycerophospholipids may be subdivided into distinct classes, based on the nature of the polar headgroup at the sn-3 position of the glycerol backbone in eukaryotes and eubacteria, or the sn-1 position in the case of archaebacteria.

Examples of glycerophospholipids found in biological membranes are phosphatidylcholine (also known as PC, GPCho or lecithin), phosphatidylethanolamine (PE or GPEtn) and phosphatidylserine (PS or GPSer). In addition to serving as a primary component of cellular membranes and binding sites for intra- and intercellular proteins, some glycerophospholipids in eukaryotic cells, such as phosphatidylinositols and phosphatidic acids are either precursors of, or are themselves, membrane-derived second messengers. Typically, one or both of these hydroxyl groups are acylated with long-chain fatty acids, but there are also alkyl-linked and 1Z-alkenyl-linked (plasmalogen) glycerophospholipids, as well as dialkylether variants in archaebacteria.

Sphingolipids

Sphingolipids are any of class of lipids containing the long-chain amino diol, sphingosine, or a closely related base (i.e. a sphingoid). A fatty acid is bound in an amide linkage to the amino group and the terminal hydroxyl may be linked to a number of residues such as a phosphate ester or a carbohydrate. The predominant base in animals is sphingosine while in plants it is phytosphingosine.

The main classes are: (1) phosphosphigolipids (also known as sphingophospholipids), of which the main representative is sphingomyelin; and (2) glycosphingolipids, which contain at least one monosaccharide and a sphingoid, and include the cerebrosides and gangliosides. Sphingolipids play an important structural role in cell membranes and may be involved in the regulation of protein kinase C.

As mentioned above, sphingolipids are a complex family of compounds that share a common structural feature, a sphingoid base backbone, and are synthesized de novo from the amino acid serine and a long-chain fatty acyl CoA, that are then converted into ceramides, phosphosphingolipids, glycosphingolipids and other compounds. The major sphingoid base of mammals is commonly referred to as sphingosine. Ceramides (N-acyl-sphingoid bases) are a major subclass of sphingoid base derivatives with an amide-linked fatty acid. The fatty acids are typically saturated or mono-unsaturated with chain lengths from 16 to 26 carbon atoms.

The major phosphosphingolipids of mammals are sphingomyelins (ceramide phosphocholines), whereas insects contain mainly ceramide phosphoethanolamines, and fungi have phytoceramide phosphoinositols and mannose-containing headgroups. The glycosphingolipids are a diverse family of molecules composed of one or more sugar residues linked via a glycosidic bond to the sphingoid base. Examples of these are the simple and complex glycosphingolipids such as cerebrosides and gangliosides.

Sterol Lipids

Sterol lipids, such as cholesterol and its derivatives, are an important component of membrane lipids, along with the glycerophospholipids and sphingomyelins. The steroids, all derived from the same fused four-ring core structure, have different biological roles as hormones and signaling molecules. The eighteen-carbon (C18) steroids include the estrogen family whereas the C19 steroids comprise the androgens such as testosterone and androsterone. The C21 subclass includes the progestogens as well as the glucocorticoids and mineralocorticoids. The secosteroids, comprising various forms of vitamin D, are characterized by cleavage of the B ring of the core structure. Other examples of sterols are the bile acids and their conjugates, which in mammals are oxidized derivatives of cholesterol and are synthesized in the liver. The plant equivalents are the phytosterols, such as β-sitosterol, stigmasterol, and brassicasterol; the latter compound is also used as a biomarker for algal growth. The predominant sterol in fungal cell membranes is ergosterol.

Prenol Lipids

Prenol lipids are synthesized from the 5-carbon precursors isopentenyl diphosphate and dimethylallyl diphosphate that are produced mainly via the mevalonic acid (MVA) pathway. The simple isoprenoids (for example, linear alcohols and diphosphates) are formed by the successive addition of C5 units, and are classified according to the number of these terpene units. Structures containing greater than 40 carbons are known as polyterpenes. Carotenoids are important simple isoprenoids that function as antioxidants and as precursors of vitamin A. Another biologically important class of molecules is exemplified by the quinones and hydroquinones, which contain an isoprenoid tail attached to a quinonoid core of non-isoprenoid origin. Prokaryotes synthesize polyprenols (called bactoprenols) in which the terminal isoprenoid unit attached to oxygen remains unsaturated, whereas in animal polyprenols (dolichols) the terminal isoprenoid is reduced.

Polyketides

Polyketides or sometimes acetogenin are any of a diverse group of natural products synthesized via linear poly-β-ketones, which are themselves formed by repetitive head-to-tail addition of acetyl (or substituted acetyl) units indirectly derived from acetate (or a substituted acetate) by a mechanism similar to that for fatty-acid biosynthesis but without the intermediate reductive steps. In many case, acetyl-CoA functions as the starter unit and malonyl-CoA as the extending unit. Various molecules other than acetyl-CoA may be used as starter, often with methoylmalonyl-CoA as the extending unit. The poly-β-ketones so formed may undergo a variety of further types of reactions, which include alkylation, cyclization, glycosylation, oxidation, and reduction. The classes of product formed—and their corresponding starter substances—comprise inter alia: coniine (of hemlock) and orsellinate (of lichens)—acetyl-CoA; flavanoids and stilbenes—cinnamoyl-CoA; tetracyclines—amide of malonyl-CoA; urushiols (of poison ivy)—palmitoleoyl-CoA; and erythonolides—propionyl-CoA and methyl-malonyl-CoA as extender.

Polyketides comprise a large number of secondary metabolites and natural products from animal, plant, bacterial, fungal and marine sources, and have great structural diversity. Many polyketides are cyclic molecules whose backbones are often further modified by glycosylation, methylation, hydroxylation, oxidation, and/or other processes. Many commonly used anti-microbial, anti-parasitic, and anti-cancer agents are polyketides or polyketide derivatives, such as erythromycins, tetracyclines, avermectins, and antitumor epothilones.

The following examples are intended to provide illustrations of the application of the present disclosure. The following examples are not intended to completely define or otherwise limit the scope of the disclosure. One of skill in the art will appreciate that many other methods known in the art may be substituted in lieu of the ones specifically described or referenced herein.

EXAMPLES

Example 1

Generating the Library and Isolation of Candidate Strains

In this example, an insertional mutagenesis library was generated to isolate candidates resistant to high concentrations of Sodium Chloride. All DNA manipulations carried out in this example were essentially as described by Sambrook et al., Molecular Cloning: A Laboratory Manual (Cold Spring Harbor Laboratory Press 1989) and Cohen et al., *Meth. Enzymol.* 297, 192-208, 1998.

Figure 8:
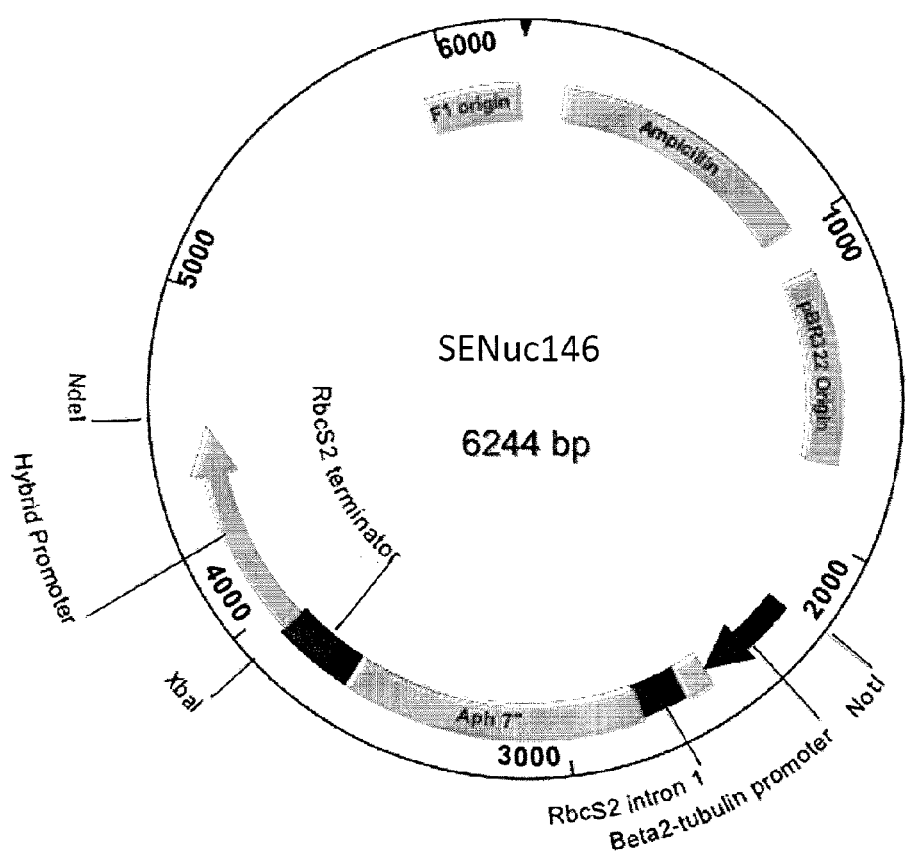
FIG. 8 shows an exemplary vector, SENuc 146 used in the transformation of the nuclear genome of Chlamydomonas reinhardtii to generate the gene disruption library. The hygromycin resistance gene is indicated by "Aph 7". It is preceded by the C. reinhardtii Beta2-tubulin promoter and followed by the C. reinhardtii rbcS2 terminator. The first intron from the C. reinhardtii rbcS2 gene is inserted within Aph 7" to increase expression levels and consequentially, the number of transformants. Following the rbcS2 terminator is the segment labeled "Hybrid Promoter" which consists of a fused promoter beginning with the C. reinhardtii Hsp70A promoter, C. reinhardtii rbcS2 promoter, and the first intron from the C. reinhardtii rbcS2 gene.
Figure 9:
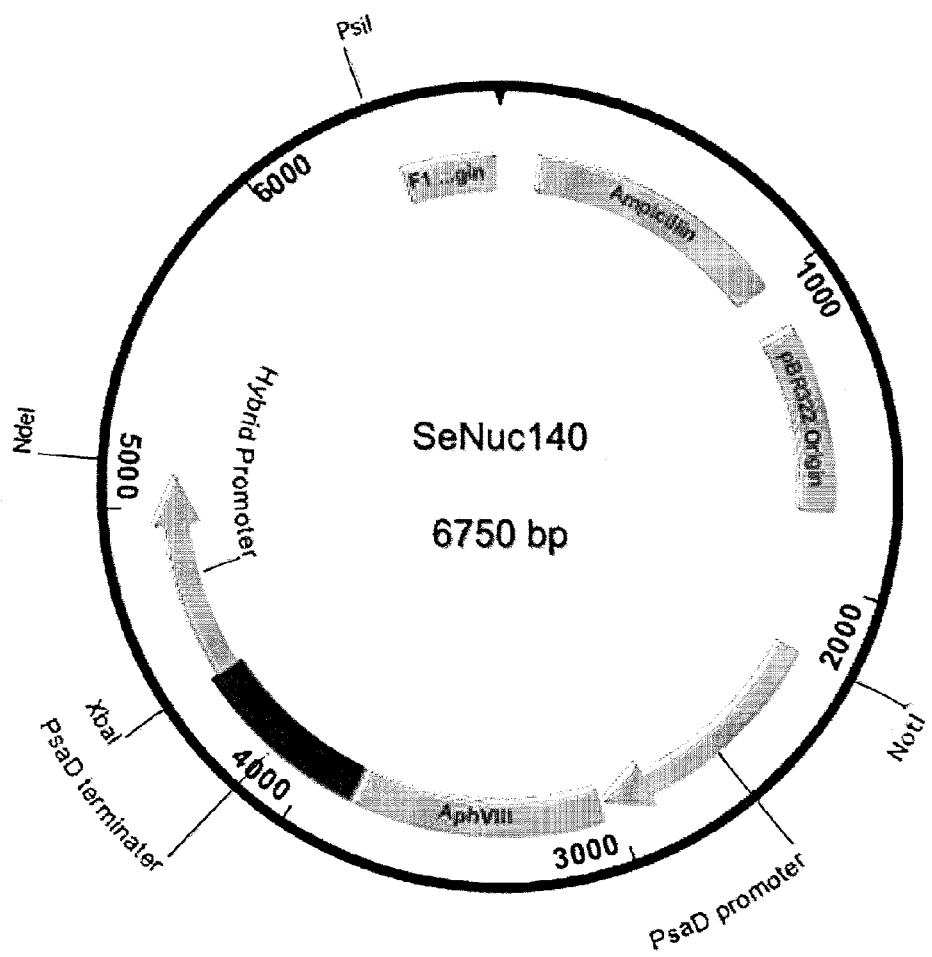
FIG. 9 shows an exemplary vector, SENuc 140 used in the transformation of the nuclear genome of Chlamydomonas reinhardtii to generate the gene disruption library. The paromomycin resistance gene is indicated by "Aph VIII". It is preceded by the C. reinhardtii psaD promoter and followed by the C. reinhardtii psaD terminator. Following the psaD terminator is the segment labeled "Hybrid Promoter" which consists of a fused promoter beginning with the C. reinhardtii Hsp70A promoter, C. reinhardtii rbcS2 promoter, and the first intron from the C. reinhardtii rbcS2 gene.
Figure 10:
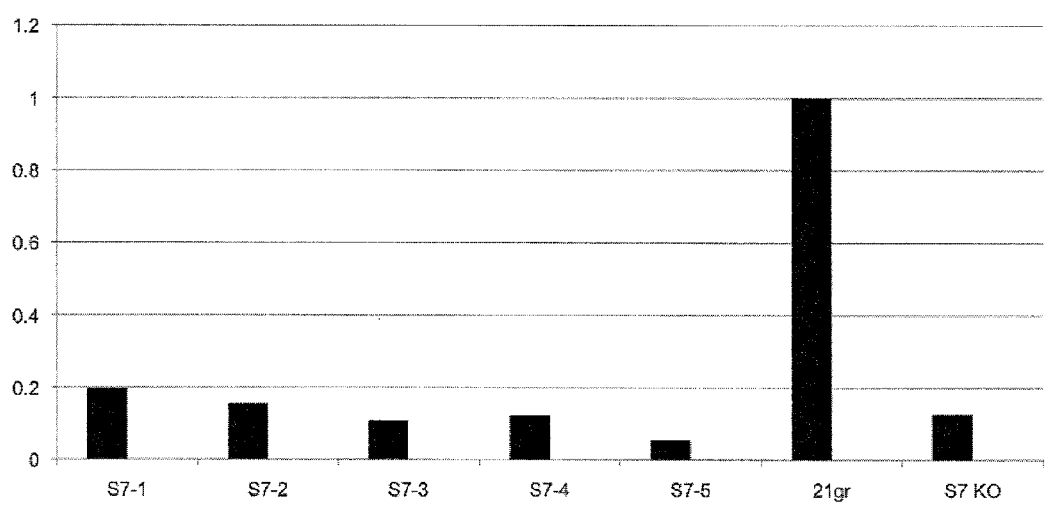
FIG. 10 shows S7 knockdown clones. The y axis is relative transcript abundance of the S7 gene and the x axis represents 5 individual clones (S7-1, S7-2, S7-3, S7-4, and S7-5), wildtype *C. reinhardtii* (21gr), and the S7 gene disruption strain (S7 KO). Also, salt tolerant strains isolated had reduced transcript levels.
Figure 11:
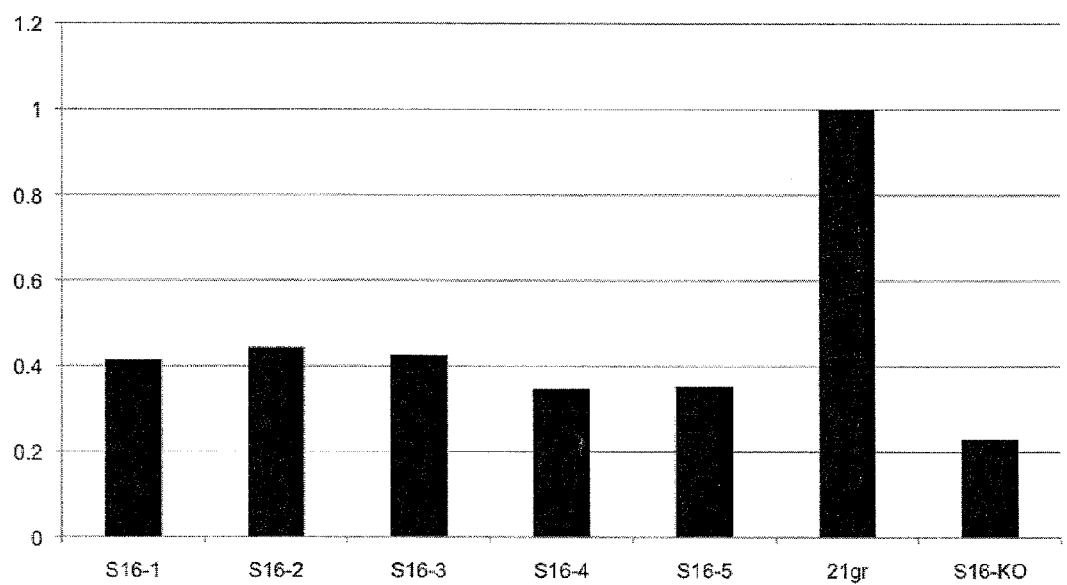
FIG. 11 shows S16 knockdown clones. The y axis is relative transcript abundance of the S16 gene and the x axis represents 5 individual clones (S16-1, S16-2, S16-3, S16-4, and S16-5), wildtype *C. reinhardtii* (21gr), and the S16 gene disruption strain (S16 KO). Also, salt tolerant strains isolated had reduced transcript levels.

Transforming DNA, the SENuc146 plasmid shown in FIG. 8, was created by using pBluescript II SK(−) (Agilent Technologies, CA) as a vector backbone. The segment labeled Aph 7" is the hygronmycin resistance gene from *Streptomyces hygroscopicus*. The first intron from the *Chlamydomonas reinhardtii* rbcS2 gene is cloned into Aph 7" in order to increase expression levels and consequentially, the number of transformants (Berthold et al. *Protist* 153:401-412 (2002)). Aph 7" is preceded by the *Chlamydomonas reinhardtii* β2-tubulin promoter and is followed by the *Chlamydomonas reinhardtii* rbcS2 terminator. Subsequently, the segment labeled "Hybrid Promoter" indicates a fused promoter region beginning with the *C. reinhardtii* Hsp70A promoter, *C. reinhardtii* rbcS2 promoter, and the first intron from the *C. reinhardtii* rbcS2 gene (Sizova et al. *Gene*, 277:221-229 (2001)). The SENuc140 plasmid (FIG. 9) was created by substituting Aph 7" cassette with the gene encoding the aminoglycoside-O-phosphotransferase VIII (Aph VIII) from *Streptomyces rimosus* flanked by the promoter and terminator of the *C. reinhardtii* psaD gene. Expression of Aph VIII confers resistance to the antibiotic paromomycin and has been shown to yield large numbers of transformants (Sizova et al. *Gene*, 181:13-18 (1996)).

Transformation DNA was prepared by digesting either SENuc 146 or SENuc 140 with the restriction enzymes NotI and NdeI followed by DNA gel purification to separate the selectable marker cassette from the backbone vector. For these experiments, all transformations were carried out on *C. reinhardtii* cc1690 (mt+). Cells were grown and transformed via electroporation. Cells were grown to mid-log phase (approximately 2-6×10$^6$ cells/ml) in TAP media. Cells were spun down at between 2000×g and 5000×g for 5 min. The supernatant was removed and the cells were resuspended in TAP media+40 mM sucrose. 250 ng (in 1-5 µL H$_2$O) of transformation DNA was mixed with 250 µL of 3×10$^8$ cells/mL on ice and transferred to 0.4 cm electroporation cuvettes. In order to generate a sufficient number of transformants, at least 50 transformation reactions were set up. Electroporation was performed with the capacitance set at 25 uF, the voltage at 800 V to deliver 2000 V/cm resulting in a time constant of approximately 10-14 ms. Following electroporation, the cuvette was returned to room temperature for 5-20 min. For each transformation, cells were transferred to 10 ml of TAP media+40 mM sucrose and allowed to recover at room temperature for 12-16 hours with continuous shaking. Cells were then harvested by centrifugation at between 2000×g and 5000×g, the supernatant was discarded, and the pellet was resuspended in 0.5 ml TAP media+40 mM sucrose. The resuspended cells were then plated on solid TAP media+20 µg/mL hygromycin or solid TAP media+20 µg/mL paromomycin. 50 transformations, using a total of 12.5 µg of purified transformation DNA, would typically yield approximately 200,000 individual transformants.

Transformants were then scraped into 1 L liquid TAP media and allowed to recover at room temperature for 48 hours with continuous agitation. After one to two days of the library recovering in TAP media, a cell density count was taken. In order to ensure full coverage of the library, 10× of the library size was needed. For example, if the library size was 2×10$^5$ transformants, then 2×10$^6$ cells were carried on for selection.

As indicated above, 10× of the library size was spun down in triplicate at 3000×g for 5 minutes. The pellets were washed 3 times with 50 mL of G$_0$ media. After the washes, the pellets were resuspended in 10 mL of liquid G$_0$ media and plated on Bioassay Trays (Nunc catalog number 240835) containing solid G$_0$ media+75 mM NaCl, G$_0$+100 mM NaCl, and G$_0$+125 mM NaCl. G$_0$ media is composed of 0.07 mM FeCl$_3$, 11.71 mM Na$_2$EDTA, 0.0002 mM CoCl$_2$, 0.0003 mM ZnSO$_4$, 0.0001 mM CuSO$_4$, 0.0035 mM MnCl$_2$, 0.0001 mM Na$_2$MoO$_4$, 1.42 mM NaNO$_3$, 0.21 mM NaH$_2$PO$_4$, 0.003 mM Thiamine Hydrochloride, 0.0000019 mM Vitamin B$_{12}$, 0.0000106 mM Biotin, 0.406 mM MgSO$_4$☐7H$_2$0, 0.0476 mM CaCl$_2$☐2H$_2$0, 0.162 mM H$_3$BO$_3$, 0.00710 mM NaVO$_3$, 5.95 mM NaHCO$_3$. In addition, parallel liquid assays were performed using the same range of NaCl concentrations (data not shown). Plates were then placed at room temperature in high light in a box fed with 5% CO$_2$. Colonies tolerant to increased NaCl appeared about 10 to 14 days later. Colonies were struck out on solid G$_0$ media for single colonies to ensure clonality. Single colonies were then picked into liquid G$_0$ media for secondary screening.

Candidates were plated onto solid G$_0$ media+75 mM NaCl, G$_0$+100 mM NaCl, and G$_0$+125 mM NaCl. Candidates were also inoculated 1:100 (v:v) into liquid G$_0$ media+75 mM NaCl, G₀+100 mM NaCl, and G₀+125 mM NaCl. This process was utilized both to confirm the phenotype, but also to qualitatively rank order the candidates by level of resistance. Confirmed candidates were carried forward for identification and validation (Table 1).

Example 2

Segregation Analysis of Candidate Strains

Segregation analysis was another method to validate that the random insertion of the exogenous DNA containing a selectable marker conferring antibiotic resistance is genetically linked to the observed phenotype. The mating type + and mating type − of *Chlamydomonas reinhardtii* can be crossed. The S7 candidate strain (mating type +) was crossed with *C. reinhardtii* cc1691 (mating type −) by growing both separately on solid TAP media for 5-7 days at room temperature and high light. Cells were resuspended in nitrogen-free liquid TAP media for 2 hours under light. 200 µl of both S7 and cc1691 were mixed and left for at least 2 hours to mate. Cells were plated on solid HSM media and grown overnight under light and subsequently stored in the dark for 3 days. Chloroform vapor treatment was applied for 30 seconds to eliminate gametes. The plate was placed under light for approximately one week to allow the zygote to germinate. Clonal colonies were obtained by serial dilution.

5 colonies that were resistant to hygromycin and 5 colonies that were sensitive to hygromycin were inoculated into liquid G₀ media and liquid G₀ media+75 mM NaCl. The results shown in FIG. 41 demonstrate that the phenotype segregates with the antibiotic resistance. This validates that the phenotype is physically linked with the gene disruption.

Example 3

Identification of Candidate Strains and miRNA Knockdown Analysis

In this example, the identity of the gene disruption of all candidate strains that were resistant to 75 mM-125 mM NaCl was determined. Subsequently, artificial miRNAs were designed to knockdown the identified gene to reproduce the phenotype as a means of validation. All DNA manipulations carried out in this example were essentially as described by Sambrook et al., Molecular Cloning: A Laboratory Manual (Cold Spring Harbor Laboratory Press 1989) and Cohen et al., *Meth. Enzymol.* 297, 192-208, 1998.

Identification

Candidate strains confirmed with the desired phenotype were grown on solid TAP media+20 µg/mL hygromycin or solid TAP media+20 µg/mL paromomycin depending on the transformation DNA used. Approximately 5 mL of a saturated culture was processed to isolate genomic DNA. Genomic DNA was isolated from individual mutants (colonies), using the Promega Wizard Genomic DNA Purification Kit (Promega Cat. #A1125). The procedure for "Isolation of Genomic DNA from Plant Tissue" outlined in the technical manual for the kit was followed. Results from identification are summarized in Table 1. Genome walking encompasses many methods, each resulting in limited success, that have been used to identify the DNA sequence flanking a region of known identity. Three main methods were utilized to maximize the success rate of identification. The methods are described.

Adaptor Ligation Method or Cassette PCR Adaptor 500 ng-1 µg genomic DNA of a candidate strain was digested with blunt end restriction enzymes (PmlI and PvuII) as recommended by the manufacturer (NEB). Digested genomic DNA was purified with Promega Wizard DNA Clean-up system (Promega Cat. #A7280). In order to generate the adaptor, both adaptor primers (see Table 3 for SEQ ID NO: 88 and SEQ ID NO: 89) were resuspended in STE buffer (10 mM Tris-HCl pH 8.0, 50 mM NaCl, 1 mM EDTA). 25 µL of each adapter pair was mixed into one reaction and annealed from 96° C. to 4° C. by decreasing 0.5° C. per second. 4 µl of digested and purified genomic DNA from each candidate was ligated to the 2 µl of 25 µM adaptor using T4 DNA ligase as recommended by the manufacturer (NEB). Primary PCR with adaptor ligated genomic DNA was performed under the following conditions: 1 µl ligated DNA, 1×Ex Taq Buffer (Takara Bio inc), 0.5M Betaine, 3% DMSO (dimethyl sulfoxide), 0.1 mM dNTPs, 1 µM Adaptor Primer 1 (SEQ ID NO: 92, see Table 3), 1 µM cassette-specific primer (SEQ ID NOS: 96, 97, 101, 102, 106, 107, 110, and 111, see Table 3 for an appropriate cassette-specific primer) and 1 unit Ex Taq (Takara Bio inc) in a 20 µl reaction volume. There were several options for the cassette-specific primer: hygromycin or paromomycin-specific, 5' and/or 3', and two or three primers within each specification. Primary PCR parameters were as follows: 1 cycle [95° C. for 2 min], 35 cycles [94° C. for 20 sec, annealing at 55° C. for 20 sec, extension at 72° C. for 4 min], and 1 cycle [extension at 72° C. for 2 min].

A secondary nested PCR was then performed with 0.5 µl of the primary PCR reaction, 1 µM Adaptor Primer 2 (SEQ ID NO: 93, see Table 3), 1 µM nested cassette-specific primer (SEQ ID NOS: 98, 99, 100, 103, 104, 105, 108, 109, 112, 113, 114, see Table 3 for an appropriate nested-cassette specific primer), 1×Ex Taq Buffer (Takara Bio inc), 0.5M Betaine, 3% DMSO (dimethyl sulfoxide), 0.1 mM dNTPs, and 1 unit Ex Taq (Takara Bio inc) in a 20 µl reaction volume. There were several options for the nested cassette-specific primer: hygromycin or paromomycin-specific, 5' and/or 3', and two or three primers within each specification. Secondary PCR parameters were as follows: 1 cycle [94° C. for 2 min], 42 cycles [95° C. for 20 sec, annealing at 57° C. for 20 sec, extension at 72° C. for 4 min], and 1 cycle [extension at 72° C. for 2 min]. PCR reactions were observed on a 1% agarose/EtBr electrophoresis gel. Bands were excised and purified using Zymoclean Gel DNA Recovery Kit (Zymo research Cat. #D4022). Purified DNA was sequenced using the appropriate AP2 primer or the appropriate nested cassette-specific primer. BLAST analysis was used to identify the location of the insert in the *Chlamydomonas reinhardtii* nuclear genome (http://genome.jgi-psf.org/Chlre4/Chlre4.home.html).

BLAST analysis was used to determine the identity of the disrupted gene.

Inverse Tandem Repeat (ITR) or Suppression PCR 500 ng-1 µg genomic DNA of a candidate strain was digested with blunt end restriction enzymes (PmlI and PvuII) as recommended by the manufacturer (NEB). Digested genomic DNA was purified with Promega Wizard DNA Clean-up system (Promega Cat. #A7280. In order to generate the adaptor, both adaptor primers (see Table 3 for SEQ ID NO: 90 and SEQ ID NO: 91) were resuspended in STE buffer (10 mM Tris-HC pH 8.0, 50 mM NaCl, 1 mM EDTA). 25 µL of each adapter pair was mixed into one reaction and annealed from 96° C. to 4° C. by decreasing 0.5° C. per second. 4 µl of digested and purified genomic DNA was ligated to 2 µl of 25 µM adaptor using T4 DNA ligase as recommended by the manufacturer (NEB).

Primary PCR with adaptor ligated genomic DNA was performed under the following conditions: 1 µl ligated DNA, 1×Ex Taq Buffer (Takara Bio inc), 0.5M Betaine, 3% DMSO (dimethyl sulfoxide), 0.1 mM dNTPs, 1 µM Adaptor Primer 3 (SEQ ID NO: 93, see Table 3), 1 µM cassette-specific primer (SEQ ID NOS: 96, 97, 101, 102, 106, 107, 110, and 111, see Table 3 for an appropriate cassette-specific primer) and 1 unit Ex Taq (Takara Bio inc) in a 20 µl reaction volume. There were several options for the cassette-specific primer: hygromycin or paromomycin-specific, 5' and/or 3', and two or three primers within each specification. Primary PCR parameters were as follows: 1 cycle [95° C. for 2 min], 35 cycles [94° C. for 20 sec, annealing at 55° C. for 20 sec, extension at 72° C. for 4 min], and 1 cycle [extension at 72° C. for 2 min].

A secondary nested PCR was then performed with 0.5 µl of the primary PCR reaction, 1 µM Adaptor Primer 4 (SEQ ID NO: 94, see Table 3), 1 µM cassette-specific primer (SEQ ID NOS: 98, 99, 100, 103, 104, 105, 108, 109, 112, 113, 114, see Table 3 for an appropriate nested cassette-specific primer), 1×Ex Taq Buffer (Takara Bio inc), 0.5M Betaine, 3% DMSO (dimethyl sulfoxide), 0.1 mM dNTPs, and 1 unit Ex Taq (Takara Bio inc) in a 20 µl reaction volume. There were several options for the nested cassette-specific primer: hygromycin or paromomycin-specific, 5' and/or 3', and two or three primers within each specification. Secondary PCR parameters were as follows: 1 cycle [95° C. for 2 min], 42 cycles [95° C. for 20 see, annealing at 57° C. for 20 sec, extension at 720° C. for 4 min], and 1 cycle [extension at 72° C. for 2 min]. PCR reactions were observed on a 1% agarose/EtBr electrophoresis gel. Bands were excised and purified using Zymoclean Gel DNA Recovery Kit (Zymo research Cat. #D4022). Purified DNA was sequenced using the appropriate AP4 primer or the nested cassette-specific primer. BLAST analysis was used to identify the location of the insert in the Chlamydomonas reinhardtii nuclear genome (http://genome.jgi-psf.org/Chlre4/Chlre4.home.html). BLAST analysis was used to determine the identity of the disrupted gene.

Restriction-Site PCR

Restriction site PCR takes advantage of endogenous restriction sites within the genome that helps serve as priming sites for PCR amplification (Sarkar, G., et al. (1993) Genome Res. 2: 318-322). Primary PCR with candidate strain genomic DNA was performed under the following conditions: 1 µl of 100 ng/µl DNA, 1×Ex Taq Buffer (Takara Bio inc), 0.5M Betaine, 3% DMSO (dimethyl sulfoxide), 0.1 mM dNTPs, 1 µM RSO primer (SEQ ID NO: 241 or SEQ ID NO: 242 in Table 3 can be used), 1 µM cassette-specific primer (SEQ ID NOS: 96, 97, 101, 102, 106, 107, 110, and 111, see Table 3 for an appropriate cassette-specific primer), and 1U Ex Taq (Takara Bio inc) in a 20 µl reaction volume. There were several options for the cassette-specific primer: hygromycin or paromomycin-specific, 5' and/or 3', and two or three primers within each specification. Primary PCR parameters were as follows: 1 cycle [94° C. for 2 min], 30 cycles [94° C. for 1 min, annealing at 55° C. for 1 min, extension at 72° C. for 3 min], and 1 cycle [extension at 72° C. for 10 min].

Secondary nested PCR was performed with 0.5 µl of the primary PCR reaction, 1×Ex Taq Buffer (Takara Bio, Inc.), 0.5M Betaine, 3% DMSO (dimethyl sulfoxide), 0.1 mM dNTPs, 1 µM of the same RSO primer used in the primary PCR, 1 µM nested cassette-specific primer (SEQ ID NOS: 98, 99, 100, 103, 104, 105, 108, 109, 112, 113, 114, see Table 3 for an appropriate nested cassette-specific primer), and 1U Ex Taq (Takara Bio inc) in a 20 µl reaction volume. There were several options for the cassette-specific primer: hygromycin or paromomycin-specific, 5' and/or 3', and two or three primers within each specification. Secondary nested PCR parameters were as follows: 1 cycle [94° C. for 2 min], 30 cycles [94° C. for 1 min, annealing at 55° C. for 1 min, extension at 72'C' for 3 min], and 1 cycle [extension at 72° C. for 10 min]. PCR reactions were observed on a 1% agarose/EtBr electrophoresis gel. Bands were excised and purified using Zymoclean Gel DNA Recovery Kit (Zymo research Cat, #D4022). Purified DNA was sequenced using the appropriate AP2 primer or the nested cassette-specific primer. BLAST analysis was used to identify the location of the insert in the Chlamydomonas reinhardtii nuclear genome (http://genome.jgi-psf.org/Chlre4/Chlre4.home.html). BLAST analysis was used to determine the identity of the disrupted gene.

Artificial miRNA Mediated Silencing

Figure 5:
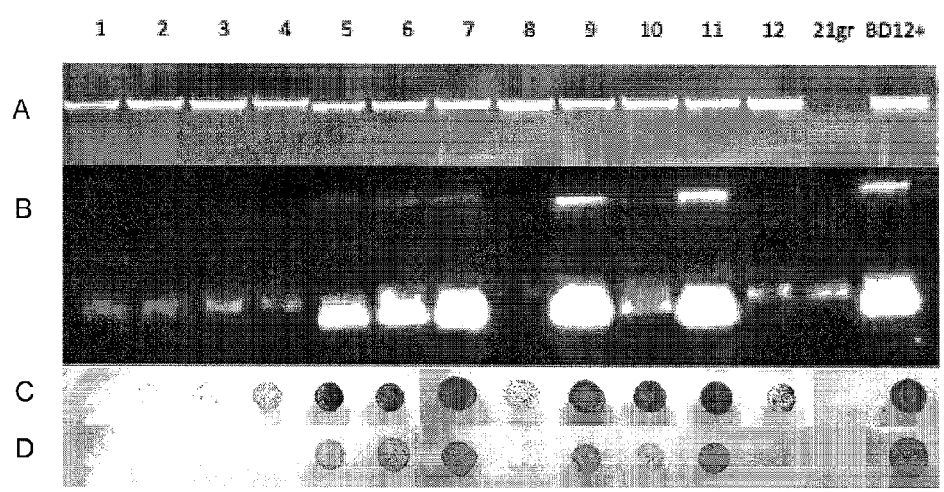
FIG. 5 shows analysis of 12 transformants containing the BD12 silencing cassette followed by a wildtype control labeled "21gr" and a BD12-containing strain without the BD12 cassette. A BD12 gene screen control (row A); a western blot (row B); sensitivity to solid TAP media+10 μg/mL zeocin (row C); and sensitivity to solid TAP media+40 μg/mL zeocin (row D) were performed to demonstrate the variance of knockdown as a product of individual transformation events. As BD12 expression is silenced, BD12 protein levels decrease along with an increase to zeocin sensitivity.
Figure 6:
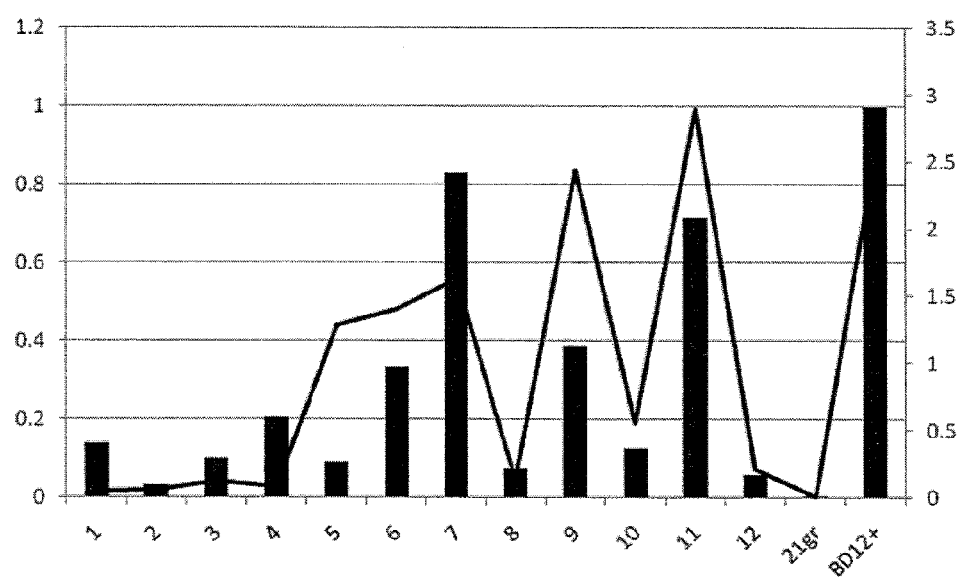
FIG. 6 shows analysis of lysates and cDNA preps of 12 transformants containing the BD12 silencing cassette followed by a wildtype control labeled "21gr" and a BD12-containing strain without the BD12 silencing cassette. The left-hand y axis is transcript level normalized to the control labeled "BD12+"; the right-hand y axis is xylanase activity (units/s); the x axis represents each of the 12 transformants including positive and negative controls. The bars represent the BD12 relative transcript abundance as determined by quantitative PCR; and the solid line represents xylanase activity. As BD12 expression is silenced, BD12 transcript levels decrease along with a decrease in xylanases activity.

Sequence characterization of the gene disruption (See Table 1) allows for validation by RNA interference. Expression of a transcript may be suppressed by expressing inverted repeat transgenes or artificial miRNAs (Rohr, J., et al., Plant J, 40, 611-621 (2004); Molnar et al., Nature, 447:1126-1130 (2007); Molnar et al., Plant J, 58:165-174 (2009)). An example of the artificial miRNA system is shown in FIG. 5 and FIG. 6. A strain transformed with an expression cassette that produces two proteins, a Zeocin resistance protein and a xylanase (BD12), from a single transcript, was transformed with an artificial miRNA cassette to target the xylanase transcript. The variation of efficacy was shown by the 12 individual strains. Some strains were not knocked down (high in xyalanse activity, high in Zeocin resistance, high in xylanase transcript level), but some strains were knocked down (low in xlanase activity, sensitive to Zeocin, and low in xyalanse transcript). These data verified that applying artificial miRNA constituted a validation method. Reproducing the salt resistance by silencing the identified gene target validates the gene target as the genetic determinant of the phenotype.

Figure 1:
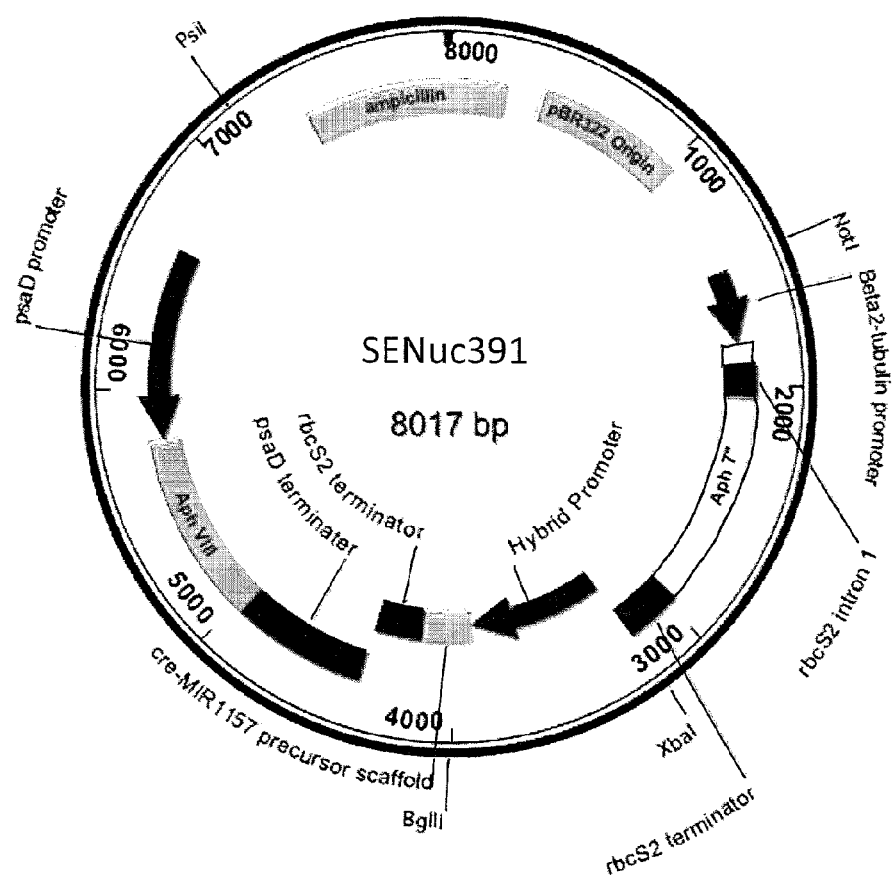
FIG. 1 shows an exemplary vector, SENuc391 used in the transformation of the nuclear genome of Chlamydomonas reinhardtii to express an artificial miRNA. The hygromycin resistance gene is indicated by "Aph 7". It is preceded by the C. reinhardtii Beta2-tubulin promoter and followed by the C. reinhardtii rbcS2 terminator. The first intron from the C. reinhardtii rbcS2 gene was inserted within Aph 7" to increase expression levels and consequentially, the number of transformants. The paromomycin resistance gene is indicated by "Aph VIII". It is preceded by the C. reinhardtii psaD promoter and followed by the C. reinhardtii psaD terminator. The segment labeled "Hybrid Promoter" which consists of a fused promoter beginning with the C. reinhardtii Hsp70A promoter, C. reinhardtii rbcS2 promoter, and the first intron from the C. reinhardtii rbcS2 gene drives the expression of the cre-MIR1157 precursor scaffold. The precursor scaffold is followed by the terminator from the C. reinhardtii rbcS2 gene.
Figure 2:
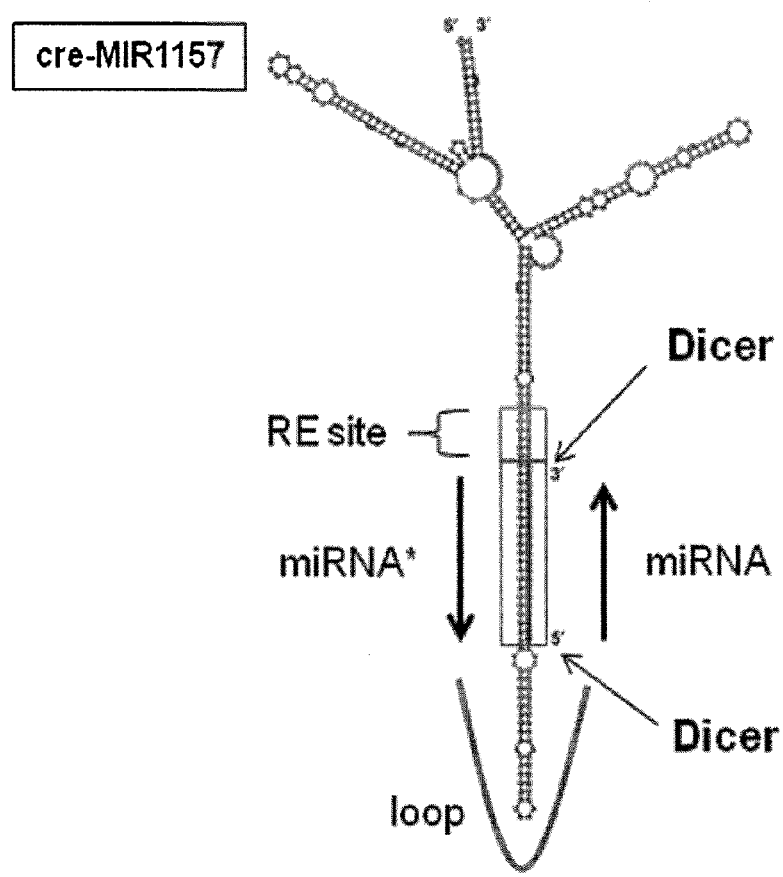
FIG. 2 shows the secondary structure of the miRNA precursor cre-MIR1157 found in Chlamydomonas reinhardtii. The label "RE site" indicates the restriction site used to ligate artificial miRNAs.
Figure 3:
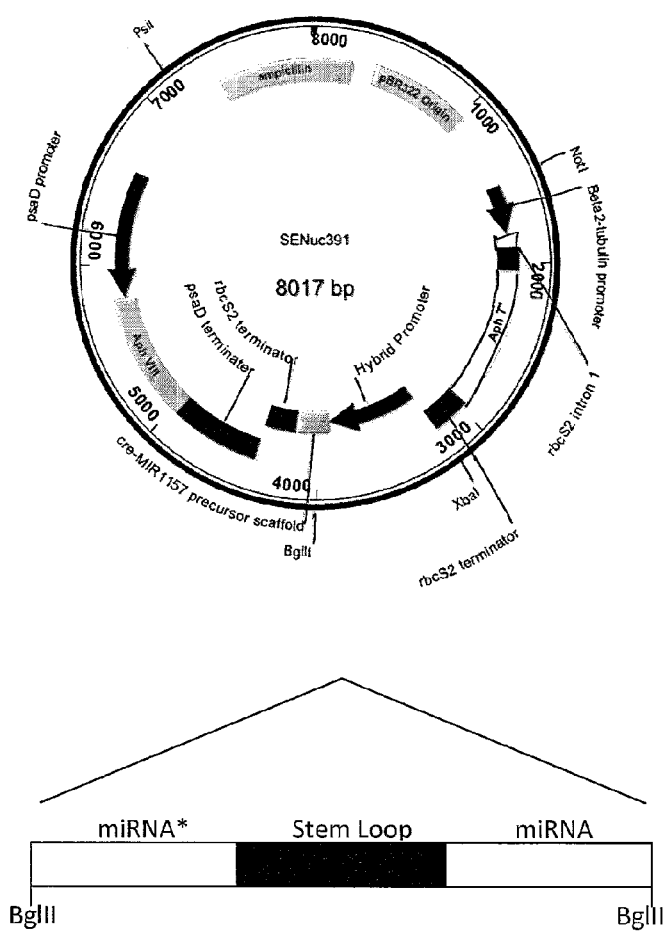
FIG. 3 shows a representative miRNA*-loop-miRNA fragment and the BglII restriction site used to ligate into SENuc391.
Figure 4:
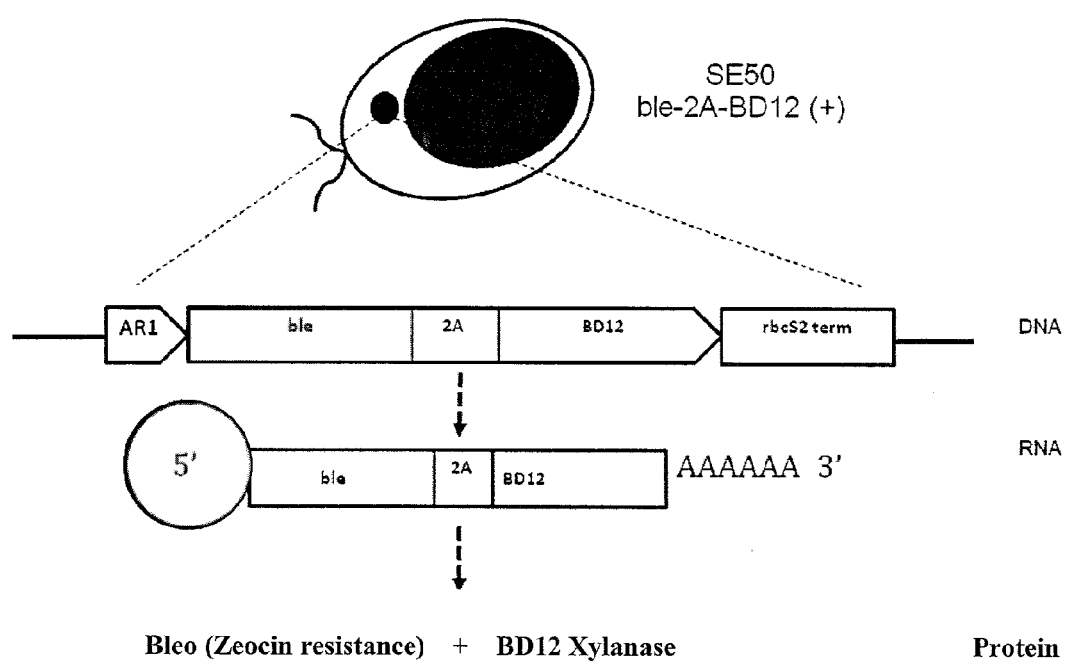
FIG. 4 shows an expression cassette containing the coding sequence for both the zeocin resistance gene (ble) and the xylanase gene (BD12) linked by the Foot-and-mouth disease virus peptide 2A. The 2A sequence results in a single mRNA transcript, but two polypeptides. RNA interference of the BD12 transcript will result in both a decrease of BD12 protein, BD12 activity, and zeocin resistance.

The artificial miRNA expression vector was constructed as follows. The modified expression vector, SENuc391 (FIG. 1), was created by using pBluescript II SK(−) (Agilent Technologies, CA) as a vector backbone. The segment labeled "Aph 7"" was the hygromycin resistance gene from Streptomyces hygroscopicus. The first intron from the Chlamydomonas reinhardtii rbcS2 gene was cloned into Aph 7" in order to increase expression levels and consequentially, the number of transformants (Berthold et al. Protist 153:401-412 (2002)). Aph 7" was preceded by the Chlamydomonas reinhardtii β2-tubulin promoter and was followed by the Chlamydomonas reinhardtii rbcS2 terminator. The hygromycin resistance cassette was cloned into the NotI and XbaI sites of pBluescript II SK(−). Subsequently, the segment labeled "Hybrid Promoter" indicates a fused promoter region beginning with the C. reinhardtii Hsp70A promoter, C. reinhardtii rbcS2 promoter, and the first intron from the C. reinhardtii rbcS2 gene (Sizova et al. Gene, 277:221-229 (2001)). The "Hybrid Promoter" was PCR amplified using overlapping primers while introducing restriction sites to both the 5' (XbaI) and 3' (NdeI, BamHI, KpnI) ends. This PCR-generated fragment was cloned into the XbaI and KpnI sites of the hygromycin resistance cassette-containing pBluescript II SK(−). The segment labeled "Aph VIII" was the paromomycin resistance gene flanked by the promoter and terminator of the C. reinhardtii psaD gene. The cassette was blunt end ligated into the digested KpnI site treated with Klenow.

The generation of the precursor scaffold was performed similarly as previously described (Molnar et al., Plant J, 58:165-174 (2009)). The 5' arm of the precursor scaffold was amplified from C. reinhardtii genomic DNA by two primers Arm Primer 1 (SEQ ID NO: 243) and Arm Primer 2 (SEQ ID NO: 244). The 3' arm of the precursor scaffold was amplified by the two primers Arm Primer 3 (SEQ ID NO: 245) and Arm Primer 4 (SEQ ID NO: 246). The two resulting PCR fragments were gel purified and fused together in a PCR reaction using the primers Arm Primer 1 (SEQ ID NO: 243) and Arm Primer 4 (SEQ ID NO: 246) resulting in a 259 bp fusion product. The PCR fragment was gel-purified, digested with AseI and BamHI, and ligated into the NdeI and BamHI sites of SEnuc391.

The transcript IDs of the candidate genes (See Table 1) were submitted to the Web MicroRNA Designer (Ossowski et al., *Plant J*, 53:674-690; WMD3, http://wmd3.weigelworld.org/). For each gene, predicted miRNAs were converted to full stem-loop sequences, including the endogenous cre-MIR1157 spacer, and the corresponding miRNA*, using the WMD3 Oligo function with "pChlamiRNA2 and 3" selected as the vector. The resulting sequences were modified by adding flanking BglII sites, as well as adding sequence complementary to the 5' end of the antisense strand of the BD11 (SEQ ID NO. 228) sequence to the 3' end. The modified sequences were synthesized and Table 2 shows the artificial miRNA sequences that are associated with the NaCl candidate strain number and gene sequence. In order to clone the miRNA stem-loop sequences into SENuc391, a complementary strand was first added by PCR amplification in the presence of BD11, each ultramer, and a primer (SEQ ID NO. 229) in a 2-cycle Phusion PCR reaction following the manufacturer's instructions (Finnzymes). The resulting double-stranded DNA fragments were cloned into the BglII site of SENuc391. The resulting plasmid was sequenced for the appropriate orientation.

TABLE 2

| Sequence Listing Number | Strain Number | amiRNA Sequence Number |
|---|---|---|
| SEQ ID NO: 115 | S7 | SEQ ID NO: 207 |
| SEQ ID NO: 116 | S16 | SEQ ID NO: 208 |
| SEQ ID NO: 122 | S65 | SEQ ID NO: 209 |
| SEQ ID NO: 201 | S1659 | SEQ ID NO: 223 |
| SEQ ID NO: 129 | S77 | SEQ ID NO: 210 |
| SEQ ID NO: 202 | S1666 | SEQ ID NO: 224 |
| SEQ ID NO: 206 | S1704 | SEQ ID NO: 227 |
| SEQ ID NO: 133 | S105 | SEQ ID NO: 211 |
| SEQ ID NO: 198 | S1612 | SEQ ID NO: 221 |
| SEQ ID NO: 200 | S1644 | SEQ ID NO: 222 |
| SEQ ID NO: 204 | S1693 | SEQ ID NO: 226 |
| SEQ ID NO: 203 | S1687 | SEQ ID NO: 225 |
| SEQ ID NO: 135 | S129 | SEQ ID NO: 213 |
| SEQ ID NO: 134 | S123 | SEQ ID NO: 212 |
| SEQ ID NO: 166 | S289 | SEQ ID NO: 215 |
| SEQ ID NO: 162 | S276 | SEQ ID NO: 214 |
| SEQ ID NO: 169 | S292 | SEQ ID NO: 217 |
| SEQ ID NO: 168 | S291 | SEQ ID NO: 216 |
| SEQ ID NO: 170 | S294 | SEQ ID NO: 218 |
| SEQ ID NO: 175 | S338 | SEQ ID NO: 220 |
| SEQ ID NO: 127 | S74 | SEQ ID NO: 235 |
| SEQ ID NO: 230 | S1613 | SEQ ID NO: 236 |
| SEQ ID NO: 231 | S1621 | SEQ ID NO: 237 |
| SEQ ID NO: 232 | S1623 | SEQ ID NO: 238 |
| SEQ ID NO: 233 | S1638 | SEQ ID NO: 239 |
| SEQ ID NO: 234 | S1655 | SEQ ID NO: 240 |

Preparation of the transformation DNA involves a restriction digest with the enzymes PsiI to linearize the DNA. All transformations were carried out on *C. reinhardtii* cc1690 (mt+). Cells were grown and transformed via electroporation. Cells were grown to mid-log phase (approximately $2\text{-}6\times10^6$ cells/ml) in TAP media. Cells were spun down gently (between 2000 and 5000×g) for 5 min. The supernatant was removed and the cells were resuspended in TAP media+40 mM sucrose. 1 µg (in 1-5 µL $H_2O$) of transformation DNA was mixed with 250 µL of $3\times10^8$ cells/mL on ice and transferred to 0.4 cm electroporation cuvettes. Electroporation was performed with the capacitance set at 25 uF, the voltage at 800 V to deliver 2000 V/cm resulting in a time constant of approximately 10-14 ms. Following electroporation, the cuvette was returned to room temperature for 5-20 min. Cells were transferred to 10 ml of TAP media+40 mM sucrose and allowed to recover at room temperature for 12-16 hours with continuous shaking. Cells were then harvested by centrifugation for 5 min at between 2000×g and 5000×g, the supernatant was discarded, and the pellet was resuspended in 0.5 ml TAP media+40 mM sucrose. The resuspended cells were then plated on solid TAP media+10 µg/mL hygromycin and +10 µg/mL paromomycin.

Selection

42 Colonies transformed with artificial miRNA constructs were picked into a 96-well microtiter plate and grown in 200 µl $G_0$ media at room temperature in high light in a box fed with 5% $CO_2$. Also included was a positive control that was highly resistant to NaCl, the original gene disruption strain as a control, and wildtype *C. reinhardtii* cc1690 (mt+) negative control. Once cultures were grown to saturation, 2 µl of culture was pipetted onto solid $G_0$ media+75 mM NaCl, $G_0$ media+100 mM NaCl, $G_0$ media+125 mM NaCl (FIG. 15-38). In FIGS. 15-32, the wildtype negative control is in position row 8 column 6, original gene disruption strain in position row 8 column 5, and the NaCl resistant positive control in position row 8 column 3 and 4. In FIGS. 33-37, the wildtype negative control is in position row 8 column 1, original gene disruption strain in position row 8 column 3, and the NaCl resistant positive control in position row 8 column 5. For FIG. 38, the wildtype negative control is in position row 8 column 6, original gene disruption strain in position row 8 column 4, and the NaCl resistant positive control in position row 8 column 2. Plates were grown at room temperature in high light in a box fed with 5% $CO_2$.

Random integration into the nuclear genome affects protein expression by positional effect. This effect was also observed when expressing artificial miRNA. Validation of the gene target was indicated by the distribution of salt gene-targeting artificial miRNA transformants that are resistant to NaCl (FIGS. 15-38) were also compared to the resistance of transformants of a random DNA fragment, for example, an artificial miRNA targeting a non-salt target. The percentage of highly resistant strains was a product of both the validity of the gene target and miRNA design. These results confirm that the genes represented by S7 (Augustus v.5 Protein ID: 523016), S16 (Protein ID: 195781), S65 (Augustus v.5 Protein ID: 517886), S1659 (Protein ID: 178706), S77 (Augustus v.5 Protein ID: 522165), S1666 (Augustus v.5 Protein ID: 514721), S1704 (Protein ID: 77062), S105 (Augustus v.5 Protein ID: 524679), S1612 (Protein ID: 103075), S1644 (Protein ID: 331285), S1693 (Protein ID: 188114), S1687 (Protein ID: 291633), S129 (Augustus v.5 Protein ID: 510051), 5123 (Augustus v.5 Protein ID: 519822), S289 (Augustus v.5 Protein ID: 518128), S276 (Augustus v.5 Protein ID: 512487). S292 (Augustus v.5 Protein ID: 524030), 5291 (Augustus v.5 Protein ID: 516191), S294 (Augustus v.5 Protein ID: 522637), S338 (Augustus v.5 Protein ID: 512361), S74 (Augustus v.5 Protein ID: 520845), S1613 (Protein ID: 174261), S1621 (Protein ID: 206559), S1623 (Protein ID: 116195), S1638 (Protein ID: 418706), S1655 (Augustus v.5 Protein ID: 525078) confer NaCl resistance when disrupted by insertion and/or silencing.

Figure 12:
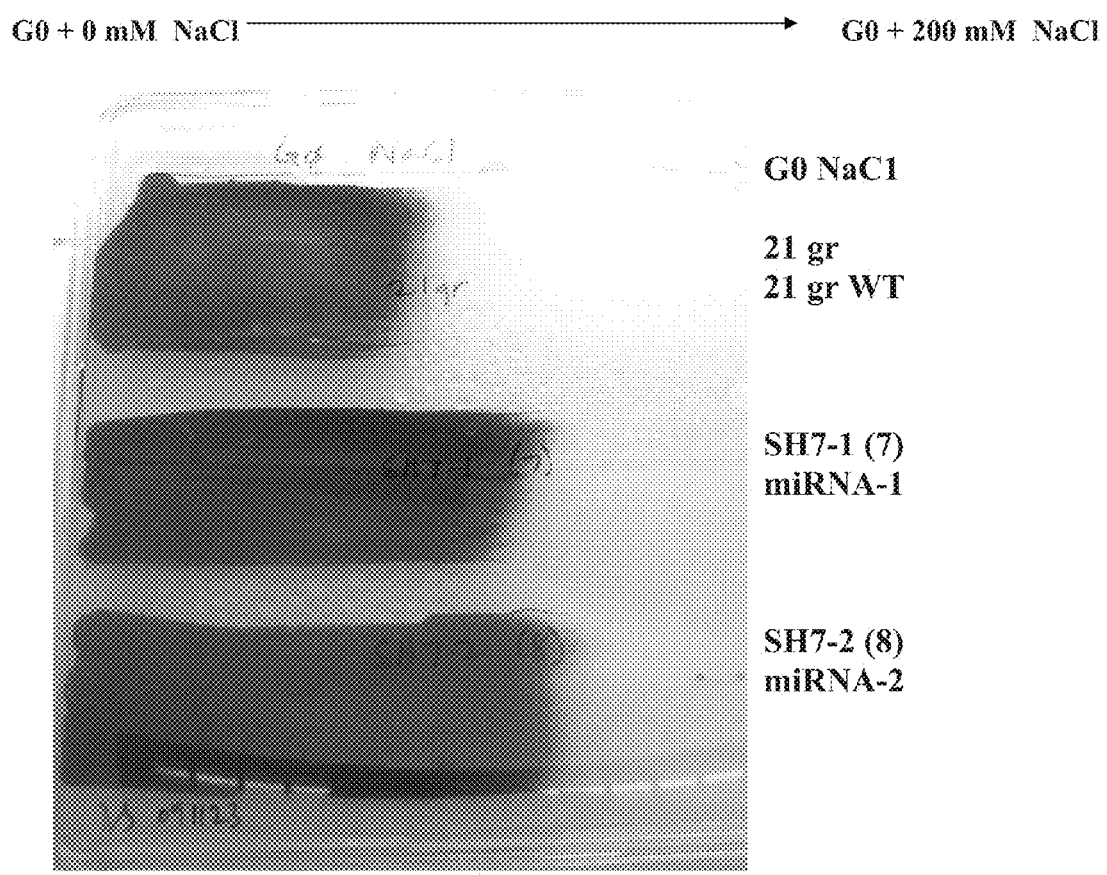
FIG. 12 shows two artificial miRNA transformations targeting S7 (rows 2 and 3) on a gradient plate from 0 mM to 200 mM sodium chloride. Wildtype *C. reinhardtii* (21gr) was plated on the top row. Transformants of the artificial miRNA targeting S7 was characterized as having increased salt tolerance.
Figure 13:
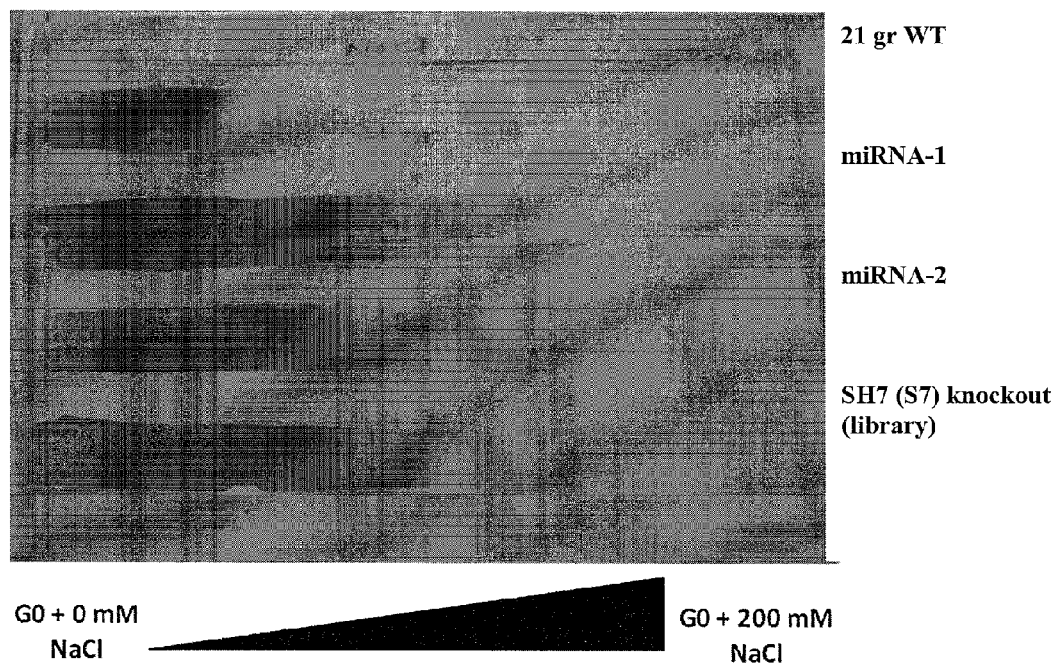
FIG. 13 shows two artificial miRNA transformations targeting S7 (rows 2 and 3) on a gradient plate from 0 mM to 200 mM sodium chloride. Wildtype *C. reinhardtii* (21gr) was plated on the top row. The original S7 gene disruption strain (acquired through the generation of the library) and labeled "SH7 (S7) knockout" was plated on the bottom row. Transformants of the artificial miRNA targeting S7 and the originally S7 gene disruption strain was characterized as having increased salt tolerance.
Figure 14:
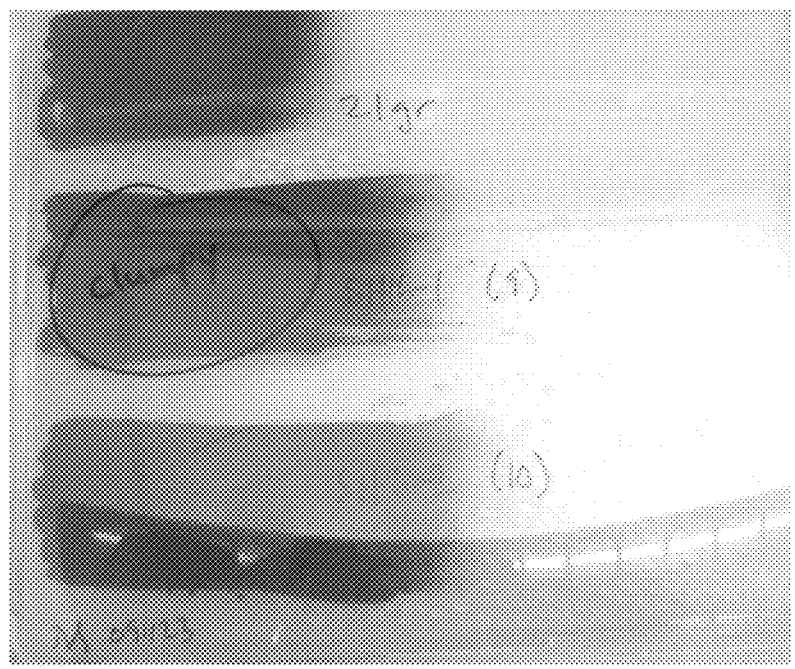
FIG. 14 shows two artificial miRNA transformations targeting S16 (rows 2 and 3) on a gradient plate from 0 mM to 200 mM sodium chloride. Wildtype *C. reinhardtii* (21gr) was plated on the top row. Transformants of the artificial miRNA targeting S16 was characterized as having increased salt tolerance.
Figure 15:
FIG. 15 shows 42 knockdown colonies for S65 with controls at 75 mM, 100 mM, 125 mM sodium chloride (left to right). The image label "S65" refers to the Plate ID #S65, strain number S65, and Augustus v.5 Protein ID: 517886. See Table 1.
Figure 16:
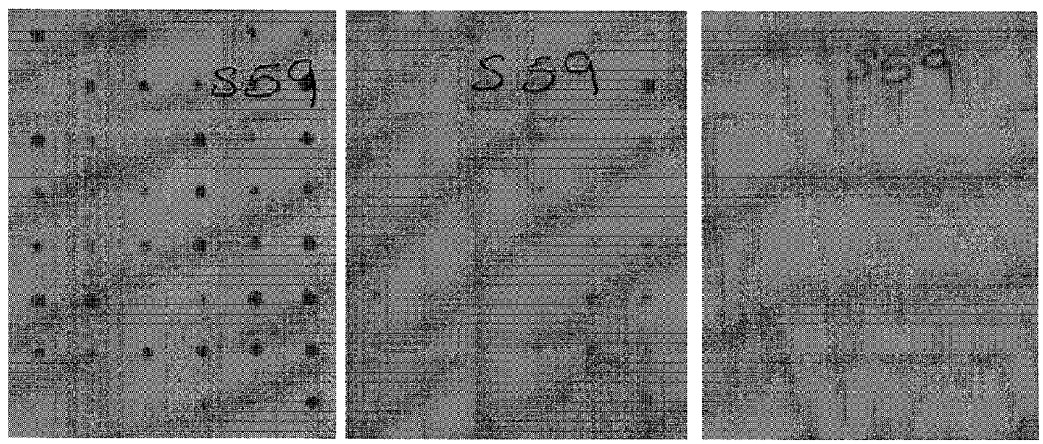
FIG. 16 shows 42 knockdown colonies for S1659 with controls at 75 mM, 100 mM, 125 mM sodium chloride (left to right). The image label "S59" refers to the Plate ID #S59, strain number S1659, and Protein ID: 178706. See Table 1.
Figure 17:
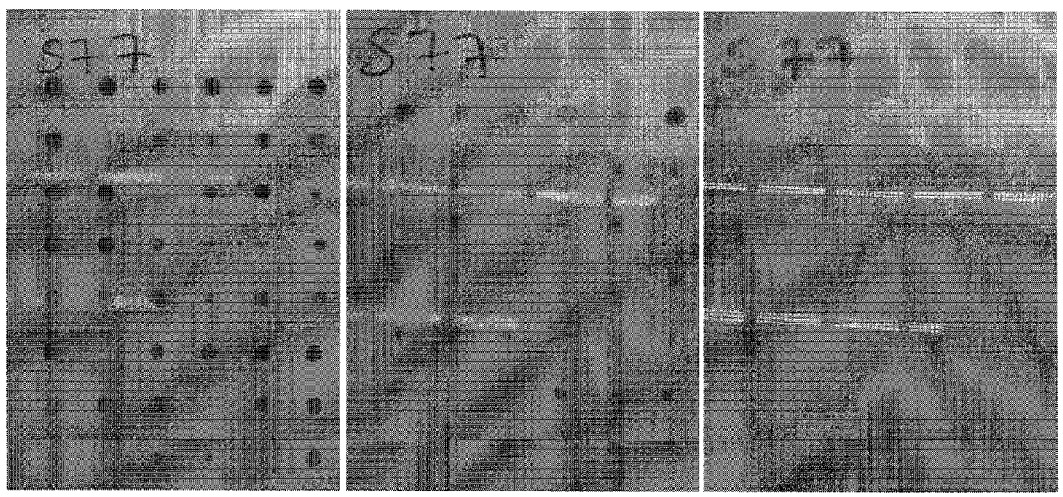
FIG. 17 shows 42 knockdown colonies for S77 with controls at 75 mM, 100 mM, 125 mM sodium chloride (left to right). The image label "S77" refers to the Plate ID #S77, strain number S77, and Augustus v.5 Protein ID: 522165. See Table 1.
Figure 18:
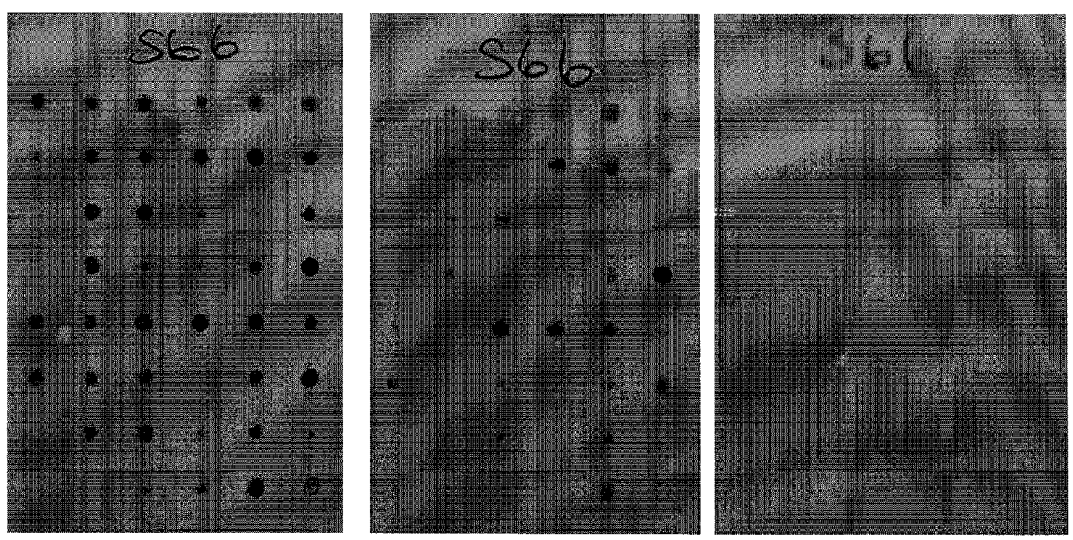
FIG. 18 shows 42 knockdown colonies for S1666 with controls at 75 mM, 100 mM, 125 mM sodium chloride (left to right). The image label "S66" refers to the Plate ID #S66, strain number S1666, and Augustus v.5 Protein ID: 514721. See Table 1.
Figure 19:
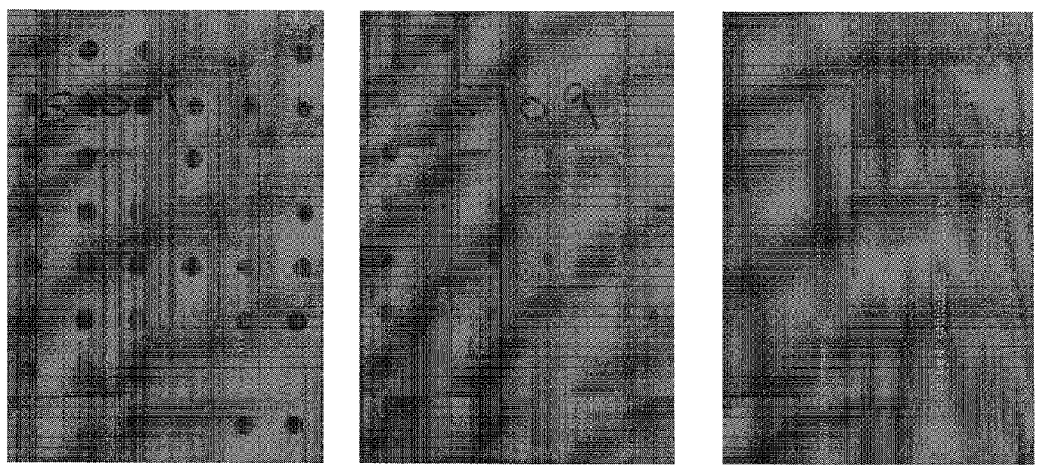
FIG. 19 shows 42 knockdown colonies for S1704 with controls at 75 mM, 100 mM, 125 mM sodium chloride (left to right). The image label "S109" refers to the Plate ID #S109, strain number S1704, and Protein ID: 77062. See Table 1.
Figure 20:
FIG. 20 shows 42 knockdown colonies for S105 with controls at 75 mM, 100 mM, 125 mM sodium chloride (left to right). The image label "S105" refers to the Plate ID #S105, strain number S105, and Augustus v.5 Protein ID: 524679. See Table 1.
Figure 21:
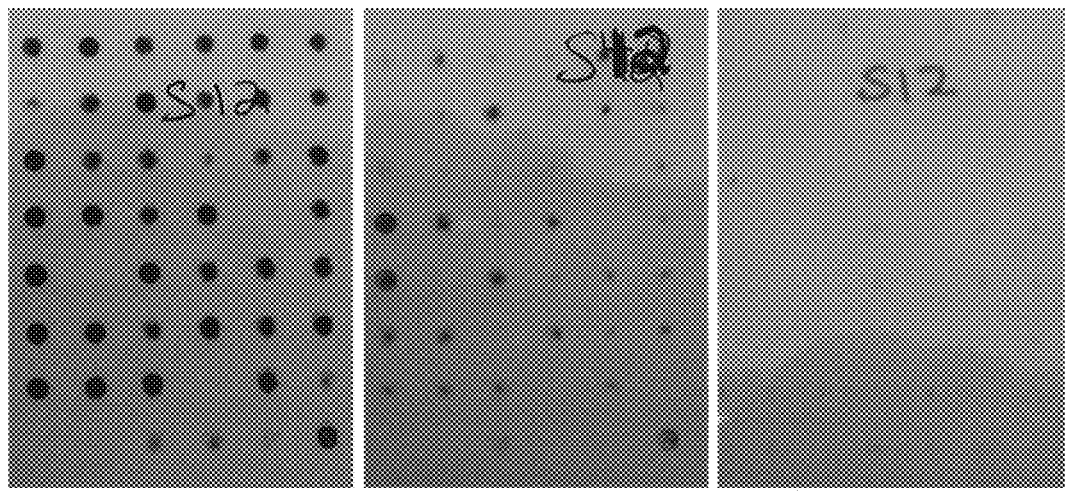
FIG. 21 shows 42 knockdown colonies for S1612 with controls at 75 mM, 100 mM, 125 mM sodium chloride (left to right). The image label "S12" refers to the Plate ID #S12, strain number S1612, and Protein ID: 103075. See Table 1.
Figure 22:
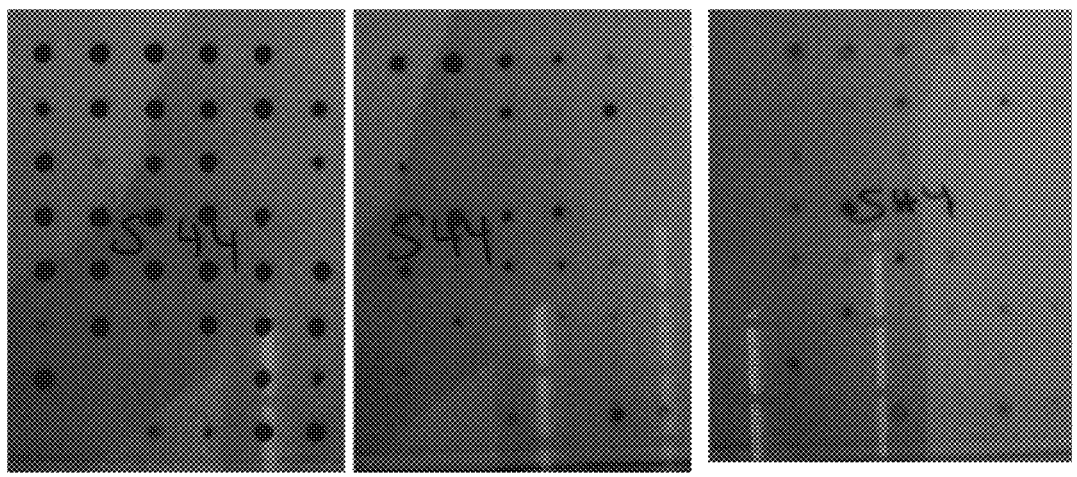
FIG. 22 shows 42 knockdown colonies for S1644 with controls at 75 mM, 100 mM, 125 mM sodium chloride (left to right). The image label "S44" refers to the Plate ID #544, strain number S1644, and Protein ID: 331285. See Table 1.
Figure 23:
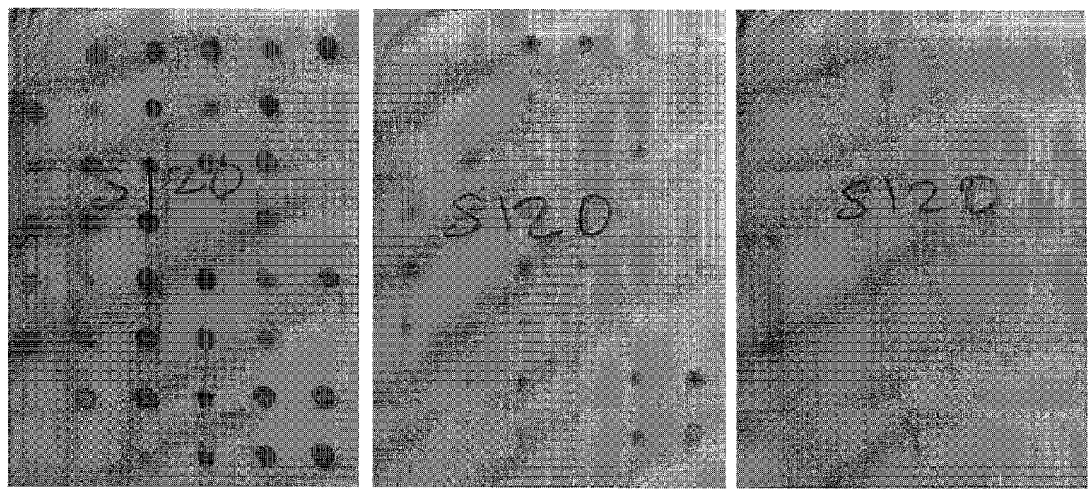
FIG. 23 shows 42 knockdown colonies for S1693 with controls at 75 mM, 100 mM, 125 mM sodium chloride (left to right). The image label "S120" refers to the Plate ID #5120, strain number S1693, and Protein ID: 188114. See Table 1.
Figure 24:
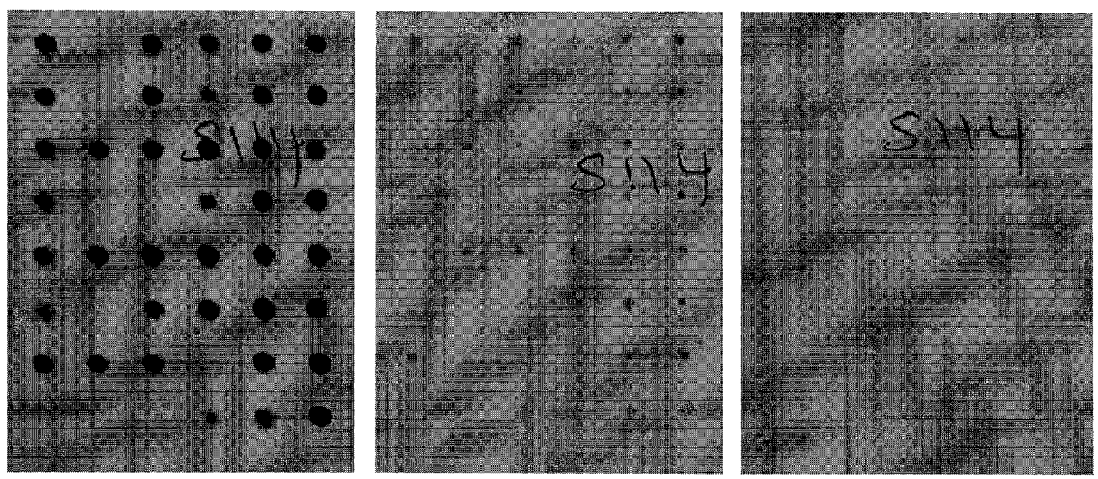
FIG. 24 shows 42 knockdown colonies for S1687 with controls at 75 mM, 100 mM, 125 mM sodium chloride (left to right). The image label "S114" refers to the Plate ID #S114, strain number S1687, and Protein ID: 291633. See Table 1.
Figure 25:
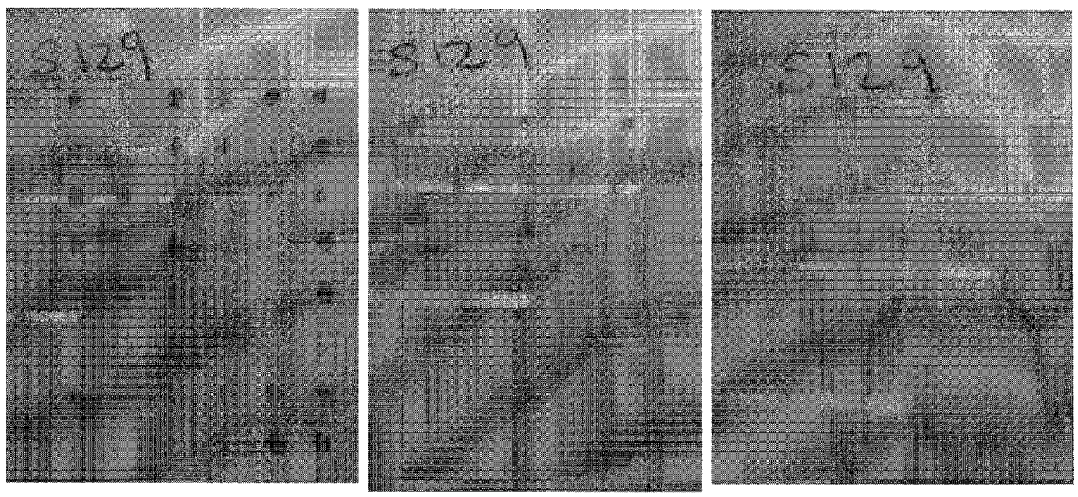
FIG. 25 shows 42 knockdown colonies for S129 with controls at 75 mM, 100 mM, 125 mM sodium chloride (left to right). The image label "S129" refers to the Plate ID #S129, strain number S129, and Augustus v.5 Protein ID: 510051. See Table 1.
Figure 26:
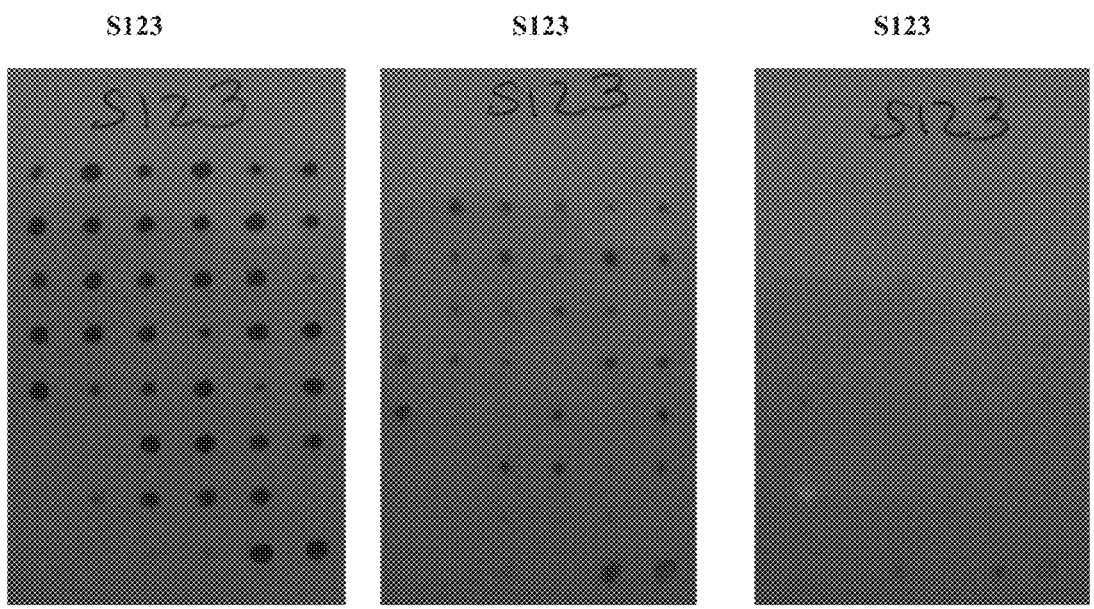
FIG. 26 shows 42 knockdown colonies for S123 with controls at 75 mM, 100 mM, 125 mM sodium chloride (left to right). The image label "S123" refers to the Plate ID #S123, strain number S123, and Augustus v.5 Protein ID: 519822. See Table 1.
Figure 27:
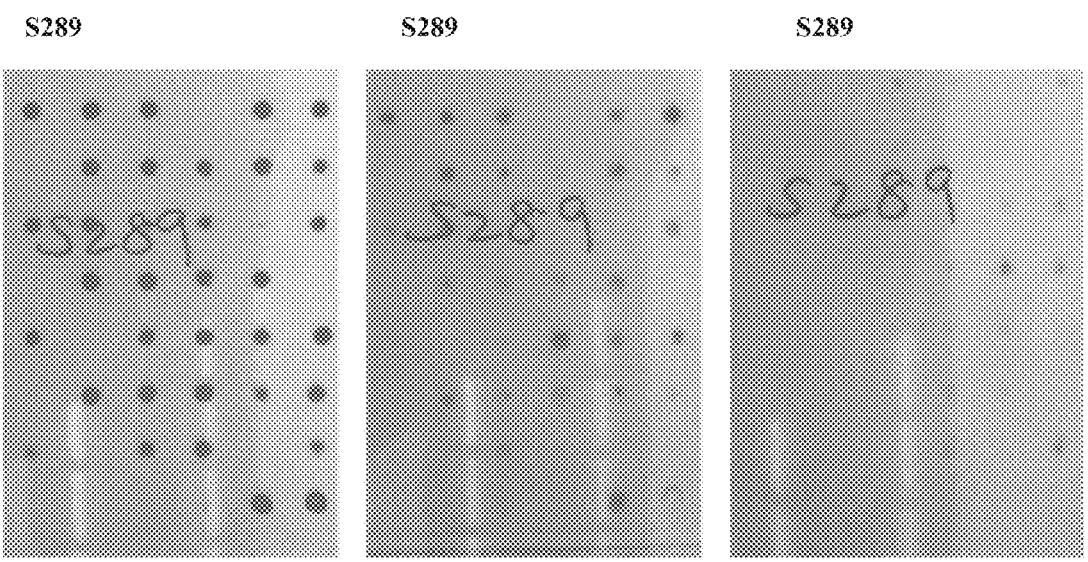
FIG. 27 shows 42 knockdown colonies for S289 with controls at 75 mM, 100 mM, 125 mM sodium chloride (left to right). The image label "S289" refers to the Plate ID #S289, strain number S289, and Augustus v.5 Protein ID: 518128. See Table 1.
Figure 28:
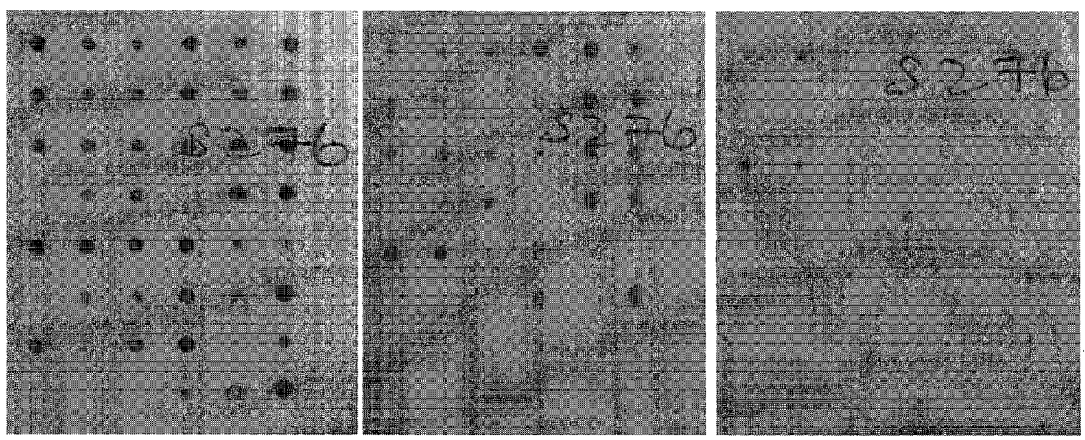
FIG. 28 shows 42 knockdown colonies for S276 with controls at 75 mM, 100 mM, 125 mM sodium chloride (left to right). The image label "S276" refers to the Plate ID #S276, strain number S276, and Augustus v.5 Protein ID: 512487. See Table 1.
Figure 29:
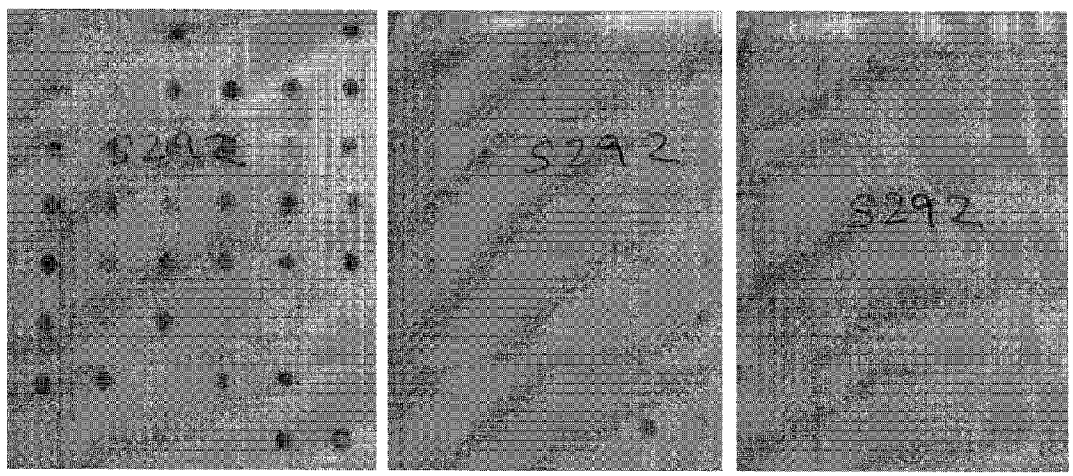
FIG. 29 shows 42 knockdown colonies for S292 with controls at 75 mM, 100 mM, 125 mM sodium chloride (left to right). The image label "S292" refers to the Plate ID #S292, strain number S292, and Augustus v.5 Protein ID: 524030. See Table 1.
Figure 30:
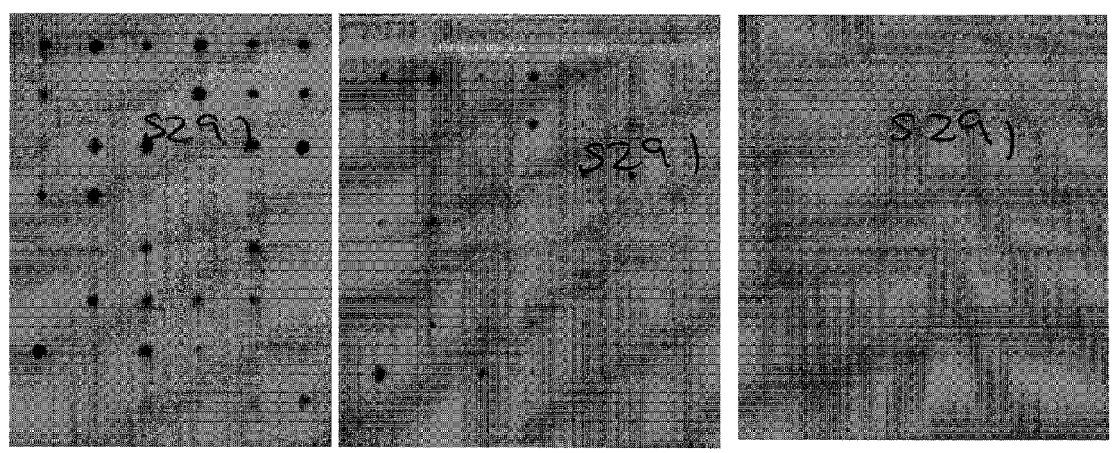
FIG. 30 shows 42 knockdown colonies for S291 with controls at 75 mM, 100 mM, 125 mM sodium chloride (left to right). The image label "S291" refers to the Plate ID #S291, strain number S291, and Augustus v.5 Protein ID: 516191. See Table 1.
Figure 31:
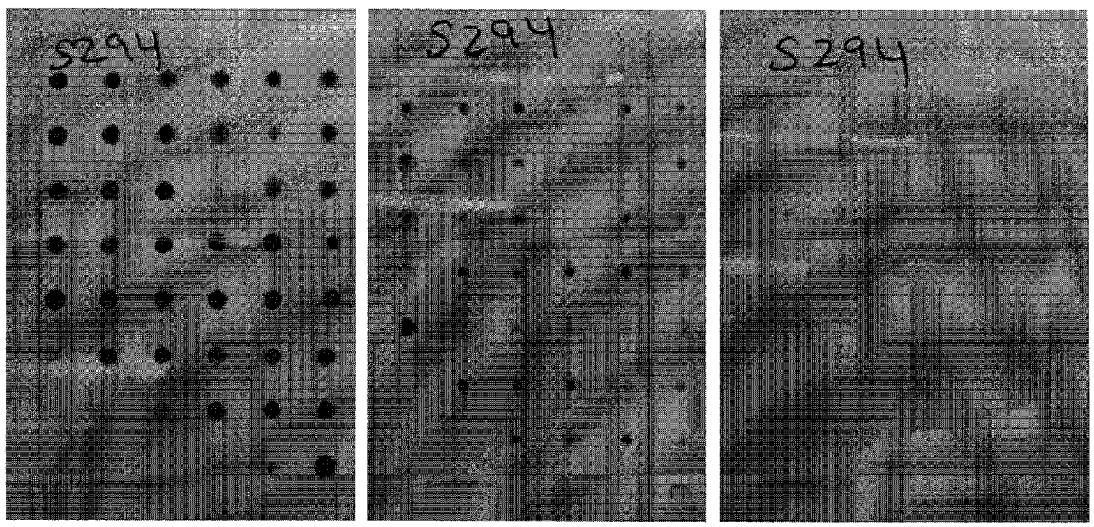
FIG. 31 shows 42 knockdown colonies for S294 with controls at 75 mM, 100 mM, 125 mM sodium chloride (left to right). The image label "S294" refers to the Plate ID #S294, strain number S294, and Augustus v.5 Protein ID: 522637. See Table 1.
Figure 32:
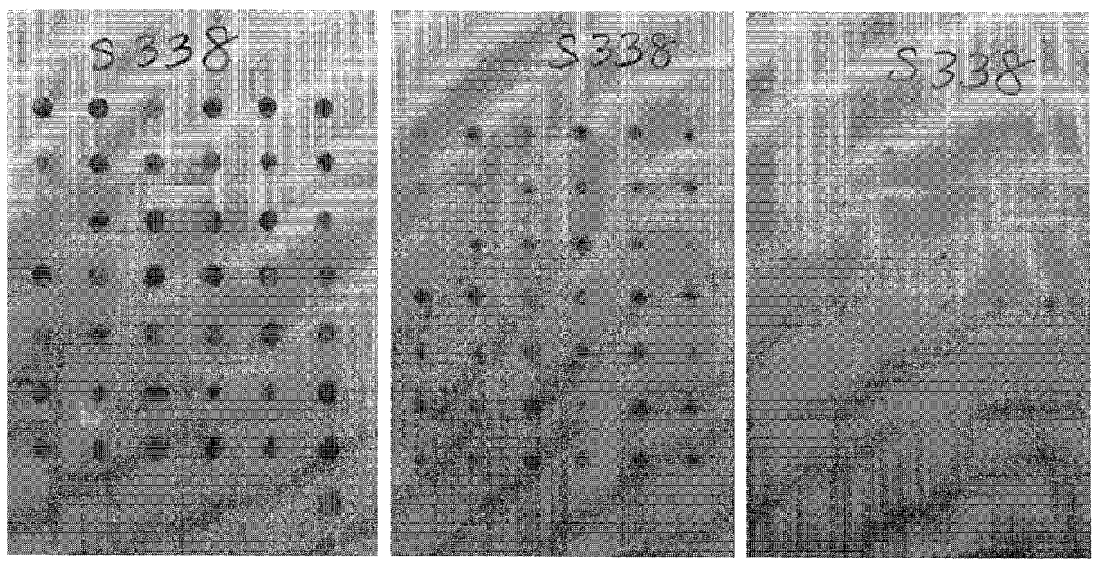
FIG. 32 shows 42 knockdown colonies for S338 with controls at 75 mM, 100 mM, 125 mM sodium chloride (left to right). The image label "S338" refers to the Plate ID #S338, strain number S338, and Augustus v.5 Protein ID: 512361. See Table 1.
Figure 33:
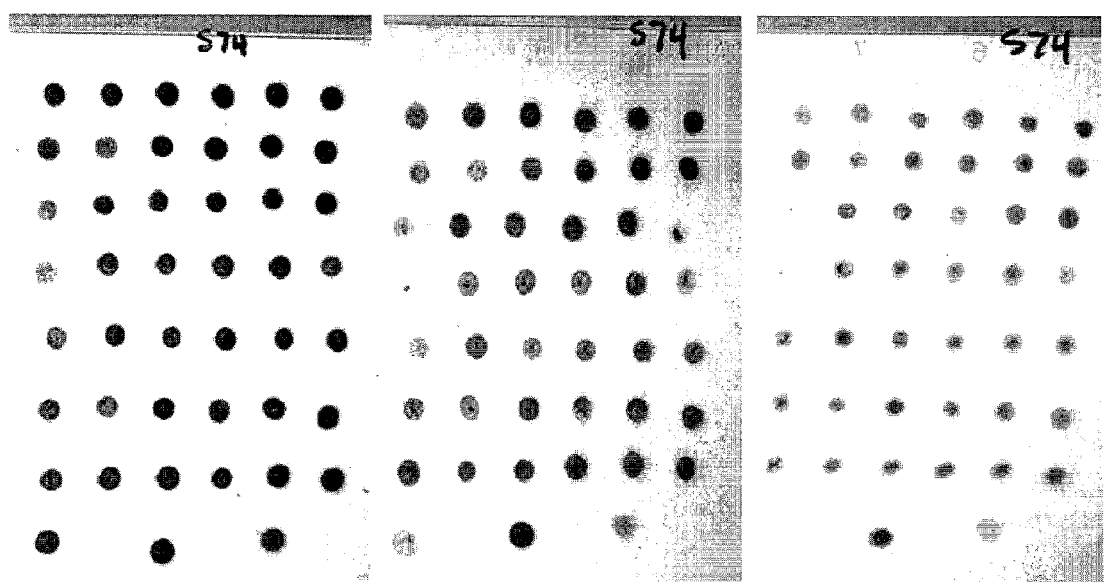
FIG. 33 shows 42 knockdown colonies for S74 with controls at 75 mM, 100 mM, 125 mM sodium chloride (left to right). The image label "574" refers to the Plate ID #S74, strain number S74, and Augustus v.5 Protein ID: 520845. See Table 1.
Figure 34:
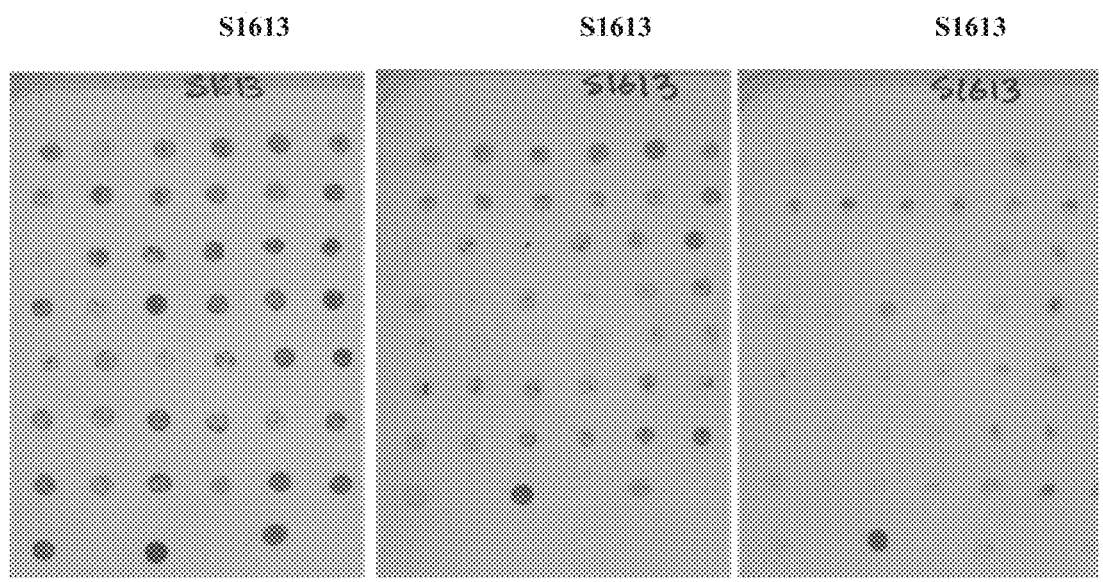
FIG. 34 shows 42 knockdown colonies for S1613 with controls at 75 mM, 100 mM, 125 mM sodium chloride (left to right). The image label "S1613" refers to the Plate ID #S1613, strain number S1613, and Augustus v.5 Protein ID: 174261. See Table 1.
Figure 35:
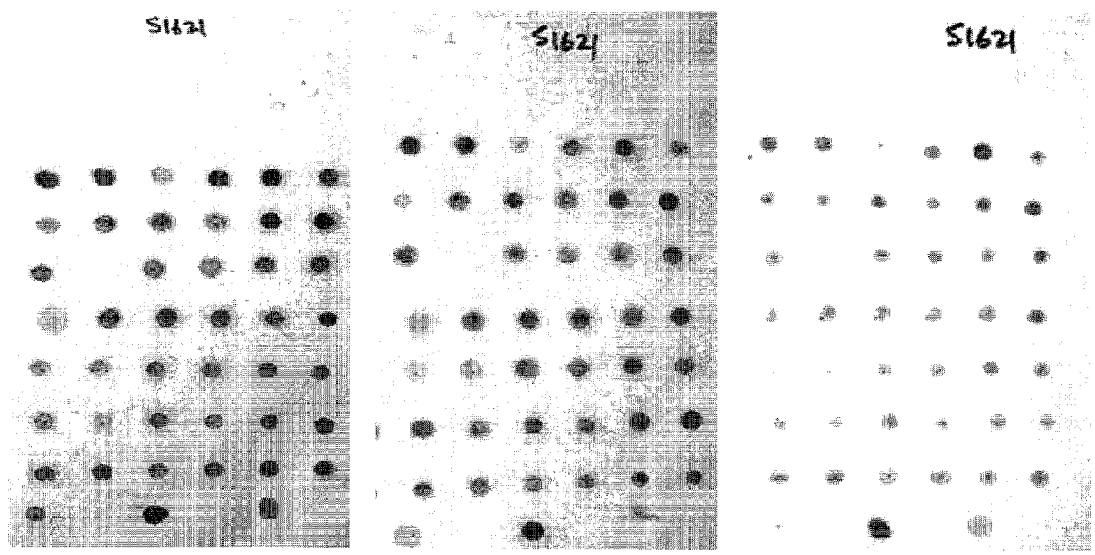
FIG. 35 shows 42 colonies for S1621 with controls at 75 mM, 100 mM, and 125 mM sodium chloride (left to right). The image label "S1621" refers to the Plate ID #S1621, strain number S1621, and Protein ID: 206559. See Table 1.
Figure 36:
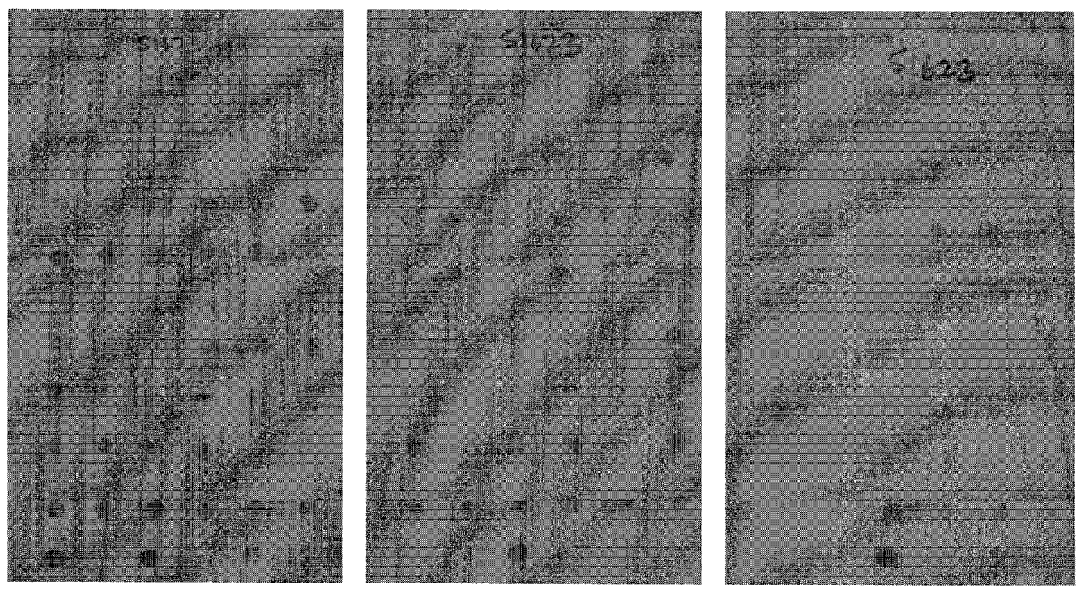
FIG. 36 shows 42 colonies for S1623 with controls at 75 mM, 100 mM, and 125 mM sodium chloride (left to right).

Phenotypes of some knockdown transformants (for strains S7 and S16) were tested on gradient salt: agar plates. 200 ml of $G_0$ agar and 200 ml of $G_0$ agar+200 mM NaCl were made. One edge of a 9"×9" bioassay tray was set at a 0.9 cm higher to create an angle. $G_0$ agar was poured first and left to solidify at an angle. The plate was returned to a level position and 200 ml of $G_0$ agar+200 mM NaCl was subsequently poured. Candidate strains S7, S16, along with their associated artificial miRNA transformation strains were grown up in $G_0$ media. Approximately 1 mL of $2.5 \times 10^7$ cells/ml culture was spread across a one-inch section of a 9"×9" bioassay tray using a sterile loop. Plated candidate strains were spread in the same direction the gradient was poured. Wildtype *C. reinhardtii* was added to the plate as well. In FIGS. 12, 13, and 14, the gene disruption strains and the knockdown transformations all show a considerable increase in salt tolerance.

Example 4

QPCR

In this example, the transcript levels of 4 salt gene targets, namely S7 (Protein ID: 143076, Augustus v.5 ID: 523016, SEQ ID NO: 115), S16 (Protein ID: 192517, SEQ ID NO: 116), S77 (Augustus v.5 ID: 522165, SEQ ID NO: 129) and S338 (Augustus v.5 ID: 512361, SEQ ID NO: 175) and their related artificial miRNA knockdown strains were examined by quantitative PCR and salt resistance. All DNA manipulations carried out in this example were essentially as described by Sambrook et al., Molecular Cloning: A Laboratory Manual (Cold Spring Harbor Laboratory Press 1989) and Cohen et al., *Meth. Enzymol.* 297, 192-208, 1998.

Further validation was performed on individual knockdown transformants by quantitative PCR to correlate phenotype to transcript levels. Decreased transcript levels were observed with an increase in salt resistance thereby further demonstrating that the phenotype is genetically linked to the gene disruption. For S7 and S16, the leading edge of the miRNA-2 bands on the gradient plates in FIGS. 12, 13, and 14 were taken and struck for single colonies. Five colonies were taken. For S77 and S338, 6 random knockdown transformants were taken. Knockdown strains were grown in 5 ml of $G_0$ media in high light in a box fed with 5% $CO_2$. Algae biomass was resuspended in plant RNA reagent (Invitrogen) and RNA was extracted according to the manufacturer. Residual DNA was removed by using RNeasy spin-column cleanup (Qiagen) to ensure purified RNA according to the manufacturer. 500 ng of RNA was reverse transcribed using iScript cDNA Synthesis Kit (Bio-Rad Laboratories) and the resulting cDNA was diluted ten-fold before PCR amplification.

Real time PCR was performed using Biorad's MyiQ2 Two-Color Real-Time PCR Detection System. Primers used in the qPCR analysis were designed and tested to ensure consistency. Reactions were performed in a 25 µl volume with the 6 µl of 4 µM primer mix, 6 µl of diluted cDNA, and 12.5 µl of iQ SYBR green super mix which contains dNTPs, iTaq polymerase, 6 mM MgCl2, SYBR green I, 20 nM fluorescein. The protocol was as follows: 1 cycle [95° C. for 30 sec], 45 cycles [95° C. for 10 sec followed by 57° C. for 30 sec], and 77 cycles [extension at 57° C. for 10 sec]. The quantification data were analyzed using the iQ5 software. Transcript levels are normalized and compared to wildtype using the transcript levels of a housekeeping gene. The qPCR results for S7, S16, S77, S338 are shown in FIG. 10, 11, 39, and FIG. 40, respectively. As only algae that were tolerant for salt were taken for S7 and S16, the transcript levels for all six samples were decreased significantly. For the cases of S77 and S338, the knockdown strains were all salt tolerant. There were subtle differences for both cases. In FIG. 39, strains S77-4, S77-5, and S77-6 had slightly higher transcript levels that correlate with decreased salt tolerance whereas those with reduced transcript levels (S77-1, S77-2, and S77-3) correlate with increased salt tolerance. In FIG. 40, strain S338-4 had a slightly higher transcript level that correlates with decreased salt tolerance whereas those with reduced transcript levels (S338-1, S338-2, S338-3, S338-5, and S338-6) correlate with increased salt tolerance. Decreased transcript levels and salt tolerance along with unchanged transcript levels and salt sensitivity further validate these gene targets as conferring salt resistance by knockout or knockdown.

TABLE 3

Adaptor Pairs

| | Adaptor Ligation Method or Cassette PCR Adaptor | |
|---|---|---|
| Adaptor 1- 5' | SEQ ID NO: 88 | GTAATACGACTCACTATAGAGTAC GCGTGGTCGACGGCCCGGGCTGGT |
| Adaptor 2- 3' | SEQ ID NO: 89 | 5' Phos-ACCAGCCCGG 3' Amino Modifier Inverse Tandem Repeat (ITR)/Suppression PCR Adaptor |
| Adaptor 3- 5' | SEQ ID NO: 90 | CTAATACGACTCACTATAGGGC TCGAGCGGCCGCCCGGGCAGGT |
| Adaptor 4- 3' | SEQ ID NO: 91 | ACCTGCCCGGGCGGCCGCTCGA GCCCTATAGTGAGTCGTATTAG |
| Adaptor Primers | | |
| | Adaptor Ligation Method or Cassette PCR Adaptor | |
| Adaptor Primer 1 | SEQ ID NO: 92 | GTAATACGACTCACTATAGAGT |
| Adaptor Primer 2 | SEQ ID NO: 93 | ACTATAGAGTACGC GTGGT Inverse Tandem Repeat (ITR)/Suppression PCR Adaptor |
| Adaptor Primer 3 | SEQ ID NO: 94 | CTAATACGACTCACTATAGG |
| Adaptor Primer 4 | SEQ ID NO: 95 | ACTATAGGGCTCGAGCGGCC |
| Hygromycin Cassette (SENuc 146) | | |
| 3' cassette-specific primer 1 | SEQ ID NO: 96 | GACCAACATCTTCGTGGACCT GGCCGC |
| 3' cassette-specific primer 2 | SEQ ID NO: 97 | GACCAACATCTTCGTGGACCT |
| 3' nested cassette-specific primer 1 | SEQ ID NO: 98 | ACTTCGAGGTGTTCGAGGAGA CCCCGC |
| 3' nested cassette-specific primer 2 | SEQ ID NO: 99 | CTGGTGCAACTGCATCTCAAC |
| 3' nested cassette-specific primer 3 | SEQ ID NO: 100 | ACTTCGAGGTGTTCGAGGAGAC |
| 5' cassette-specific primer 1 | SEQ ID NO: 101 | CTCGCCGAACAGCTTGAT |
| 5' cassette-specific primer 2 | SEQ ID NO: 102 | GGCTCATCACCAGGTAGGG |
| 5' nested cassette-specific primer 1 | SEQ ID NO: 103 | CGAATCAATACGGTCGAGAAGT AACAG |
| 5' nested cassette-specific primer 2 | SEQ ID NO: 104 | CGAATCAATACGGTCGAGAAGT |

TABLE 3-continued

| | | |
|---|---|---|
| 5' nested cassette-specific primer 3 | SEQ ID NO: 105 | AACAGGGATTCTTGTGTCATGTT |

Paromomycin Cassette (SENuc 140)

| | | |
|---|---|---|
| 3' cassette-specific primer 1 | SEQ ID NO: 106 | CTGCTCGACCCTCGTACCT |
| 3' cassette-specific primer 2 | SEQ ID NO: 107 | GACTTGGAGGATCTGGACGAG |
| 3' nested cassette-specific primer 1 | SEQ ID NO: 108 | CTGCTCGACCCTCGTACCT |
| 3' nested cassette-specific primer 2 | SEQ ID NO: 109 | GAAAAGCTGGCGTTTTACCG |
| 5' cassette-specific primer 1 | SEQ ID NO: 110 | AGAGCTGCCACCTTGACAAACAACTC |
| 5' cassette-specific primer 2 | SEQ ID NO: 111 | CAACACGAGGTACGGGAATC |
| 5' nested cassette-specific primer 1 | SEQ ID NO: 112 | TCCTCCACAACAACCCACTCACAACCG |
| 5' nested cassette-specific primer 2 | SEQ ID NO: 113 | GAGCTGCCACCTTGACAAAC |
| 5' nested cassette-specific primer 3 | SEQ ID NO: 114 | TCCTCCACAACAACCCACTC |

RSO

Restriction Site Primer Sequences

| | | |
|---|---|---|
| AgeI Primer | SEQ ID NO: 241 | TAATACGACTCACTATAGGGNNNNNNNNNNACCGGT |
| KpnI Primer | SEQ ID NO: 242 | TAATACGACTCACTATAGGGNNNNNNNNNNGGTACC |

Artificial miRNA Cloning Primers

| | | |
|---|---|---|
| 5' Arm Primer 1 | SEQ ID NO: 243 | GACTATTAATGGTGTTGGGTCGGTGTTTTTGGTC |
| 5' Arm Primer 2 | SEQ ID NO: 244 | AGATCTCAGCTGGAACACTGCGCCCAGG |
| 3' Arm Primer 3 | SEQ ID NO: 245 | GCAGTGTTCCAGCTGAGATCTAGCCGGAACACTGCCAGGAAG |
| 3' Arm Primer 4 | SEQ ID NO: 246 | GACTGGATCCGGTGTAACTAAGCCAGCCCAAAC |

RNA Blot Analyses

The transcript expression levels of the target gene in a transgenic cell line can be detected using an RNA blot technique. The RNA extraction and small RNA detection can be performed as described (for example, as described in Molnar et al., Nature, 447:1126-1129 (2007)). A detailed protocol can be found, for example, at http://www.plantsci.cam.ac.uk/Baulcombe/pdfs/smallrna.pdf. Total RNA is isolated, separated in a 15% denaturing polyacrylamide gel, and blotted to Hybond N+ (GE Lifesciences, http://www.gelifesciences.com). DNA oligonucleotides complementing to the reverse complement of an amiRNA sequence are labeled with polynucleotide kinase (PNK) in the presence of $\gamma^{32}$P-ATP and hybridized to the immobilized RNA. Decade RNA marker (Ambion, USA, http://www.ambion.com) labeled according to the manufacturer's instructions, is used as a size marker.

Example 5

Other Methods to Generate Salt Tolerant Strains by Knock Out and/or Knock Down

There are many useful approaches to generating salt tolerant strains once the sequence characterization of the gene disruption is known. As mentioned in Example 3, the expression of an artificial miRNA led to a decrease in transcript levels. Other methods of RNA silencing involve the use of a tandem inverted repeat system (Rohr et al., Plant J, 40:611-621 (2004)) where a 100-500 bp region of the targeted gene transcript is expressed as an inverted repeat. The advantage of silencing is that there can be varying degrees in which the target transcript is knocked down. Oftentimes, expression of the transcript is necessary for the viability of the cell. Thus, there can exist an intermediate level of expression that allows for both viability and also the desired phenotype (e.g. salt tolerance). Finding the specific level of expression that is necessary to produce the phenotype is possible through silencing.

Homologous recombination can be carried out by a number of methods and has been demonstrated in green algae (Zorin et al., Gene, 423:91-96 (2009); Mages et al., Protist 158:435-446 (2007)). A knock out can be obtained through homologous recombination where the gene product (e.g. mRNA transcript) is eliminated by gene deletion or an insertion of exogenous DNA that disrupts the gene.

Gene Deletion

One such way is to PCR amplify two non-contiguous regions (from several hundred DNA base pairs to several thousand DNA base pairs) of the gene. These two non-contiguous regions are referred to as Homology Region 1 and Homology Region 2 are cloned into a plasmid. The plasmid can then be used to transform the host organism to create a knockout, Gene Insertion Another way is to PCR amplify two contiguous or two non-contiguous regions (from several hundred DNA base pairs to several thousand DNA base pairs) of the gene. A third sequence is ligated between the first and second regions, and the resulting construct is cloned into a plasmid. The plasmid can then be used to transform the host organism to create a knockout. The third sequence can be, for example, an antibiotic selectable marker cassette, an auxotrophic marker cassette, a protein expression cassette, or multiple cassettes.

While certain embodiments have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (247 sequences)

SEQ ID NO: 1 - DNA, 9552 bp, Chlamydomonas reinhardtii
atgttcggtccaacgtggcggggctgctctcccgcgagggcggccagctgggccattcttactgtcgtgtcacaagtgcttgcgtgaagcgtgcttcgaggttacgggaagctcggctttgccttcccccatccccacgcaaccccccggcaaacaaactgttgacggcagaccgccgaagagaaatccaaggaggcccgcgccgctgctcgtcgtgagcggcgggcaaagaagcggcagggcctggagacgagcgcgtcgggttcgtcttcggcggagacatcaccgtcgcctgcagagcccacagctgcgccatcgccgaagtcggcttcggccgcctccagcagccccgcagcttcctccagctcgtcctcctcctcgaccacctcccggccgcggccgaagaagaacaccgtgtcgggcagcaccaccaccggccggaccagcagcagcagcagcagcaacaccagcagcggcaatggcagcggcggcggcgggggcttcaacttcggggctgtgggcgccacagtgctgggcggcattggagccttcctggggctgcagcagttcggcaaggtggggcatgagaggggggtgggggagggggaaagctggtgggggcagtacggtccggctgagagggatacgcggcgtgtgtgtggtgcgtcgccgccgctgagatggtccggcggatggagcggctcacaggcacacggggggcaagagcggcttgcagtatggtatgggtgaaggtgttgttggtgggaggaggagctgcggggcagggcggtggtggtcccagccggcacaggactgctcgcaagacaggcggcaaccggaaaccatgggccggtggaaacacatgtaagccagccgcatccgtccctggtcggccgggttttactgggatggttggggatgcaaaggtcgccccacttgtagactccgccggacggacgtcacgccgcacccctctcttgatccactgctgctgttcctgctgctcctgcccctgccgcagacgtcggactcctccaaggctgcggctctggcccaggctgtggagcggctgggtgagaagctggaggacaaggagaaggagaaggaggaggtcaaggcggtgctgcagagccaggtggggggagagcaggggggggcagggggagcaggcggcggcagtgggcctctgggttgcctgggttgtgtgtgtttccaggcgttgagtcttgcgcgatgtgccgcagctgcgcccgtgaggcgccgttcacgtcgcactgtgtgcggtcgtctcaacgcctgcccctgccgacacgtactgtgtgcctgctgctgccgcggccgcgaccccgccgcaggtggaggagctgaaggaggagaaggaggcggtgatgcaggcggccaagtgaggcggggttggggtgtgttagcgtgcagtcaggtgtacagagaccggagtccggggcggggatccagggagatgggatgaatgggggtgtatatggggccaccccagctgtcaggcaggcagttagtttgttgcaagttggagaggcgggcgcatagcctggaccgtgcttagttggcaacgctccgcctccattccccacctcccgccttccactcccgccttccactcccgccttccactcccgccttccactcccgccgccgccccaacctgcctcggtccccaggtcgcgcgaggacgagcttcaggcggtggcggtggagagccaggcggtggcgcagcagctggagagcgaggtggcggcggcgcgggcggccatccaggacaaggagcgcaagatgctggagctggagaagcaggtgcgggcggacgggaggaagggagggagggagggaggcggggtgcagcagaactaggctccacaagcaagaaaggggaagtgggggttgtatgcccgagccccacgtgcaggtcccattggcaacgactcgtcgggggcgggaggagggggctgaggcgctgcggggtggaatggtggcgggctctggcagaagggctgtggacgccagccccttgagaggcccgggagctgatgggacggacaagaggaggcgccggagcaggaggatgacgcgtgcttgttcgcgtggtcgtgccgttttttacgtttttactttggctctcactactactcgcattgcacgtttgcttgtatgtctgtgccgcctgtttgctgtttgagtccgccacgccttactgccgctcgcccatttcctgtgtgtgcttccccctgcgcgcgcggctctggcgtggcttgcattgctgagcgattaggtgagttcgcggggtcccggtttcgcgccgcagcagctaagctagccacctagacgcatgcactcagcttctttaccaacgagccttacttatcaccactactactccagactacttgctttcaataggaacttagtattttagcgttagccgccacggaaacacgggggaaccagcagcctgccgctggcgaaacaacggtatggaatgcgtcgcgtgtgcccgctgtacctctggacgtcggcacttcacttcatatttgatacacaccatcccatggatggctactcccggcccggctgactgggtgccccgatgagtccgacaccccaacccccatgatgacacacatgtccatacacatacacacacatacacacacagatcgccaagatgaagcagcagatctcaatcggcaaggaccagctgctggccacaaaggacatgaaggtgcgcgggccggggtgggggggggggggggaggggcagggcggggggcaggggaagcggggagggacacagaaggacagggaggggcttgaaggggaggagggacgcaccagggacggggaggggcatggagaggaggacaagggcgcgggctgcgggggtgatgatgcggcggcgacggggggtcctgccaatgctggtgtgctggtgtgtgggttggcgtgctggtggtgtcctgacttgtgtgtgtcctctggcgtgtcctggtgttccgcaggaggccactgcgctcatgacggacctggcgcccaaggaggtcatgctgcgggagctggaggcgcaggtgcgtgggtgttggggtgggggtaagggtagggacatggaggagggccttgtgaggcggccggagcgtgccgtgcgggaagaagtgtgtgcttggggctgtggtgccgcaggggcgttctgaccatgaaaacatgggacgccgaaacgcagccggccgcacgcgctacgctacgcagtgctcggtttgcagcccttgtccacccgccccctccccaccactgcctggcctcacctcctccccaggtggcgctgctgactgtggaggccaaggaggcgcgcatgctgctgggcgagcgcgaggccaaggtggcggcgctggaggggcaggtggcgtccatgcagtccattgtgcagtacagcaagcaggagctcagcctgcgcgcgcgggacgccgcggagctgacgcaggtgaagcaggagctgatgaccaaggagcagaaggtccgagagatgaagcagctggtgagtgggggcgggcaacaatggggggacggggcgggcaggcgggagttcgggggtgcggctgggtggccatggcccactgggccaccgtacgagaacgcatgaggagacccgggcaacttgcgcagccatcctgcgtccgtgcaagtactctagtcggccgcccctttgccttcatttctctctctgcacctgttccccaacgcacctacctgctccccatccctggtgctctactccttgactctgttctgtgacactcgcccccgggatcttctctctttctcttcctcttccgccccccgcagcttgcggagctgcagatgcagcagcagtccagccggctggagatggagtccatgcgcgaggagctggacagcgcccggtccattgccggcgagctggagaagcgcaacgcctcgctcatgcgcatgacgcagcagagcctgggccgcgagggcgacctcaagcaggcggtcaacagcaccaaggtgcggcagagagacgggaagcggtggcgtggaggcgggttgggggcggggtcgaagatggtagctacttgtactggcgctgctggggaatggcacggtggattggaatgaggggcacggggaatcgaggcaacgacacggaagtactagatagatggaactgtgggcaacgcattccacatgatgcgtgtggcaaaaattaggatgcccgcacccgcacctgcccacaccctccctatgcaacccctccctccccaacctgccgcccccccccccacaggcccaggtggccaagctggagtcggcggtcaacaccgccagccagcagctgcagcagcgggcgcagcagctggcgtccgtcaaggcctcgctggacgagcagacggcggaggtggcggcgcggcaggaggcgctggaggcgcgcgaggcggcgctggcggcggcccggcagcaggcggaggagctggaggccaagaacacggtgctggtgcgcagccgcagtgtggagctgggcaagatgcaggacctcaagcaggcgctcaacgccacccgggcgcaggtgcggatggcgcgggggcgagcgggcgggcggaggggcaggggtggaggggcccgtggaagtgtctgaagagaggaaggcaggagggtcgaaaaggttttggcaactagcgggttcgaggggagggaggcgacggcgatgaggtgacagcgcagcagggaactgtcccagcccaccgtgtccactcctgccgctcactgctcctcacttcccatcctccgcaggtgaccacgctggagaagcaggtgaaggaggccaacgtggcgctggccgtcaagtccgccaagctgcgcgagctggaggtgcaggttccggcgctgcagaaggagctggccaccggcaagcaggctctggaggcctcgcgcgccgagctgctggctgcccgcagcgccgcctccgacctggaggccaagaacacggcgctcatccggcaggccaccgccagcctgagccgcgagggcgacctcaagcaggcgctcaacatcagccgcgccgagtccgccaagctggacgacgagctgaagaaggccaaggccggcctggccgccgccagcacctcggcctcggaggccaaccagcgcctcaccgtggcggaggccaaggtgggagaggcggtggcagggagggagggagggaggcagtgagagggaggggagaggcagtgggtggagggagggtagccacccatgaaacacggtgtggacggcggtaccgtgctgttttcggctgctccagctctgcagcgctggcgcaacctatacctgctgccgccccgtatcccgccttccgcaaccaaccccgcatccacacccacgcacatcctcactcgcacacaggtgcgcgagacggagacgcagaaggcggcgctggtgcgcgacgcgcagatggccctgtcgcgcgccagcgacctgaagcaggcgctcaacgtgttcaaggagaagagcgccaagctggacggcgagctcaagagcgcgcgcacgcagctggccgccgccaccagccaggcccaggccgccaaccggcagtggcaggacgcggagaacgcgctgcgtgaggcggagcagcagcgcgagaagctggtgaagacggcgcaggtagcgatcaccaagtccacggacctcaagcaggcgctcaacgccaccaagcagcaggccaccaagctggagacggaggtcaagcaggtgaggggcgagggccggggttgaggggcccctggggcttgtgctggggcgccgcagggctgcggcagagggggagcagctcgcaggtgcaacaggtgtgaaagcggcagctggccgtgccacctggctagcaaccaccaccacaaatgacaccactgtatcccagaaccacctggcatcagggcatctgcagcaaccctgaccccaacccatcgcctgaacactcgtgcttggaaccccgtcccgccgctgacgctctcgggctgctgtgcgcctcttcccccgtgcgcctgcaggtgcgcggccagctggaggcggtgggcggccgcgcggcggaggcggagaagaagctgaccagcaccagctcgcagctggaggcggcgcgggcggagcgcgagaagctggtcaaggaggcgtcttccgcaatcaccaaggccactgacctgcgccaggtgggcgggaggggctgggcgggagggaggatagggggaggaagcagcggggcggggcggtcttcccacgtgccgccaccaaaagacagattgactgactcgtgctggcgcccacacacacacatgtgcggcacacaggagctgaatgccacccgtcagagcgccaagcagctgaacacggagctgtcccgcgcgcgcgagcagcagcagcaggcggcgcaggcggcggccgccagcagccagcagctggcctccacgcgctccgagctgagcagcaccgcggaggcgctggcggcggagcaggcgcgcgtggagaagctgagcgagcagcgggcgctggcgctgcgggagagcaaccagatgaagacggcgctggagtccaccaagcgccaggtggggagggggcggggaggaggggggctgtcgggaaggggggttagggtattgccgtcgggctgcccgggcccatcaaacaggagccaggggtgcgctctgcttcacacattccttgtgcggccgcaccgacaccttacccgcaccgacacaggcgacgcggctggaggcggaggtgaaggccacccgctcccagctcaaggcggcggagcaggaggcgcgcgaggcggaggagcagctgagcgcggcgcggcagacgctggcggtcacggagggcgcgctggccaccacaagcggccagctgagcgaggcggagaagcagaaggcggtgctcatgcgcgacatgcaggtgcggggggggggtttgtaaataccagcccaaactaaaccaaaaccaacgaaaacgggggtgcaggcagaggcgttagttgcaagcgataatacttatgggatgtgggccgaggcgtcgtggagtagcagggcgagcggctccggggggggcgagcaggaggcgtgggcggggagggggcgtgggcgggcaggaggcgtgggcggggggggggggcatatgcccgagacacgtgactggttgggacggggtggggcgccagccgtgcttggagggacgccggccggctgtggacgttagggtagctcatgtcgtgtggggcgggcaggacgtgcgtgggctttgtggccgtgttggggcgtgcgggcgggcgtgtggcgcccacagcagtagggggcggctgcagcaccataggaggcgctctggggcaggtggcactgcggtgccggggccctgtcgcgtcagcgcgccctcgcgcgctcccctccttgccctgtcggtctcctcttaacacgcctctccaccgcccctgataccactccgactagctgggctcccgcagtgcctggtgtttcaatccactggcctcactgctcgacccctggtgccacataccccccgccctccccgcacaggccagcctgggccggctgggcgacctgaagcagcagctcaacagcacgcggcagcaggcgggccagttcgaggaggccgccaagaagttccagggcgaggccgaggccgccacgggccgcctggcgcagcttcaggaccaggccgcagcagcagtcagccgctcgcaggtaaagggggggggggcggggccggggtgcggaggtggggtaggggtgagcgcgtgtgaggagcggttggctgcgtgtcggcatgggtgccagttgagggttgggccgcgacgcagggggcgtgtctgcgttgcggtttttgggcttggagcagagcgcaacaccgggcccaaggcgccggcgtacgggaccggacagccatcggccccgccccgcccacatgctgctgcctttggaatctcgctctccctccccctcctattattcccctcttccctaaccctcccccccccctggccacccaccaggcggccgagaccaagctggctgacctgagccaggcgctggcggaggcggaggccgtcaaggcctcgctgctgcgcgacagccagttggcgctgggcgcccgcggcgacctcaagcagtccctcaacatggtgcaggccaaggtgtcgcggctggaggcgcagatggcggcggccaagggcgaggccagcgccacctcgctggcggcgcgggaggcctcgcggcgggcgcagtcggcggaggcggcgctcaaggagagcgagagccggcgcgcggcggcggaggcggccgcgcgggcggcggagctgcagcgcgcgagcgcgatggcggtggcgcagggcgcgattgggcgcgagggcgacctgaagcaggcgctcaacaaggccaagcagtcggtgggtggtgcggcagggtagggcgggggcggggcgcaggggcggaaagggagctctgggggtggggaggaagggtgttgcggacatgtctggtgtggggtgcctcggtgacgaccagacaagcgccacctccatccaggaggggaggggctgggccggggctggagggtgacgctggacgccatgtcctggacactcgcacgctgtcggcaccgcccgtgcacacgcccacgaccctcccctccaccctctccgtctcgcctctcaccccgcagggctccaagctggaggatcaggtggccaaggcgcgtgacgccatgaaggcggcggaggagcggcgcgcggcggcggagaaggccatggtcaacatgcaggtgcgcggcggcggagtggcggcagggtcgtggctatgtgtgaagcgcagggggcgcgcgttggttggttgcaacgcagggctgaacgttgccagctgcgattgtgagagccgcggctgtcccaggggagctctggcctccggccaggccctgcgctcaccttaccggtaactcctgcgagtgcctcctgtgctgctgggcacccagccgtcctgctgccctgctccctgacgcacccccccccccccgccccgccccgctcctcccgctccccctcagggccagctgagcaacacggaggccaagttcacggaggcggcggcgcgcgtggcggaggcggagtcgctactgcaggtgcgagagcggaagagaggcgggggggggggaggggagagacacgtgaggtcagctggtggggattccaggcatggggagtggggcgacttcccttggggccttacagaggctgctttgttccctggctcgctggcgtctctcgaattgtgagtttgcgctgacgggcggcctcgctgggctgctcgctcgcaggcagccgaggacgcggagcgggcgacgtcgcccggccgggccggtcgcaacggcaccggcagcggcaacggcactgggagcggcgccagctacggcgtcagcggcagcagcgtccgcaacagcgttctcaagacgccctag

SEQ ID NO: 2 - DNA, 4309 bp, Chlamydomonas reinhardtii
atgccgtcgacgcttcaaggcacgttccacacctaccgcattatcaggcggctgggacaaggagccttcggagaggttagctcgcacctgcgtcccggcgggcaagcgccggactggacctttgtttctaccgggggcactggtcaacccctcccctttccgctgacaaccctgcacacccgccgctcgcaggtgtctctagcgggcgtactggagacgggtgaggtggtggcactcaagcgcatccacattcgcaacaccgggggcatacctgacgtggtggtgcgcgagatcaaggcgctgcagagcgtgagccatcccaacgtggtggcgctgctggatgtgttcccaaaggtcagcggggaaacagggggtttgctaggatgagtggagagctgggatgatagggataggggaatggagcccgggctgtttgaagtcctgttgacgggctaccgtttgagtgacggaagttaggtgtgccgataatcgcaccctagcggcaaagcctaaaggaccacgaggagcaaccgtgcaggggcgagtgcagctgagtgtctacacgtccgcggctgctgcatcacggctgtcgggcacgtgcgccacccacacagccagcaccttcctgctcacatctacagcgccgcgcactttccaaaaccgcacgcctccggcggctgtcccccccccccaacaccctctggacccgcacctagggccaggccatctacctggttcaggagtactgcaccaccgacctggcggcgctgctgcggcggctgcccgcgcccccgccggagcgcatcgccaaggggctcatgctgcagctgtgccgtggcctggaggcgctgcacgcagagggtgagagcggggtgggggctggggctgggggctgctttggctagggctggtgctgggcggggtgcgcagctcgacagcagggcggggcaggggctgctggcacgccagcgactacacgcaaggtgttcgcagggtgtgctcatgagcatgcatgtcctcctacctcatcccaataccggcagtgcacgggtgtatgacgtctcgccacccgctcctgcccactgacctcctcccgccgcgtgccgctcaactggatgcccgccttcctgccgggccaccacgcacccacaggcatcatgcatcgcgatgtgaaggtgcgccatgttgcgcgcattcgtcattgtgcctgctatcagacgccctaggcatgccgggcctgtcgtcacgcttacggtcgaccccagtccctgcctatcccgcccgctgcccgccccgcccgcccggctcctacccaactcccacccttctccgtgcccccccccccgcgccgtcctcctcgcagccgagcaacacgctgctgtccgccgcctccggcaccgccaagctggcggactgcggcctggcgcggccgctggacggcggcgagcggcccgcctacacgcacgcggtggccacgcgctggtaccgcgctcccgagctgctgtacggcgctcgcgcgtacggcccggcggtggacgtgtgggcgctggggctggtgttcgcggagctgctgggtgaggagggtgcgggggcagggcaaggttgctggaaggcgaagtggggcgggggtaaaggacgccatgccccaacgtggcaatgtggtaagcgatgttgagaaggggagtgagcggtgtgggttgagagagcgggaagatgactgcgttgacgtgcgggctgcaggcaaggactattgttgcacggtgcacgtgaccgcgcgcgcaccgcaaccagcaccggcacgctcccgtaccaaccctagacccatccccccacggttggcatccccactacccgcccgcgggtgttcccgcgtcgttccgcgcaggcctgtctccgctggtccccggcgacaacgacatcgaccagctgggccgcgtcatcgccaccttcggctctatggagccagtctggctgggcgtgcgagcgctgccggactggggcaagatcgccttcccgcactgcgagccgctgccgctgggcgacctgttgccgggcgcgccggcggcggccctggagttcctggcggccttcctcaggtgggcggcgcggcagagtgtcagggcggcgcggtggggcggcgcggtggggagcgccgtgtgtgggactgttgcaggattgggaatggccgtagggttcatgggggccggctggaggctgcaggaaaggagagcgcagggcgtggggatgatgagcctgttgtgtcagttgctagcgccgacacgcacactccctggccccgcctgcacacacacacactcactcactcactcactcactcactcactcactcactcactcactcactcactcactcactcactcactcactcactcactcactcactcactcactcactcactcactcactcactcactcactcactcactcactcactcactcacacacacatacacacacacatgcgcacacttgcgggatacgggttatgcacgggttcgagggtgacgggcacacgccctttttgggctgagcccccccagcgcagcgttccaggggggggcgaagcccccccaggaacacccctgtccgtgctgcgtgcgtgcgttagtatttgttaatgcctattgcatgtaaataggtggcagggaaaattcgggcggagcgagaagtgccttcgcgcgtccatggaaattgactttcgcgaggtcgcgaggaaagcatccggtgcccgccgatatgcagtctataaggcaaactatgttggcggcaagcaaagcggggaagtatatcgaaagttgtgagcgacttgctgagccatgcctgccgacgcgccagaatgccgagaagccccgaggtcgcccccgccccgcgcctagccctttgagcgtggggcgccggggaggtgttgagtatggcaggaggcgaaagatatgcgtggggtgtttcggaacgtgacaaggcacgcatgtggcgcgggaaatcccgcacgaccccaacccgagtgtccctagccgatgcgcctgcgcgtcgtagcggcatggaggctctaacggggcgttacacgcctattagctcccaagcgtacgggggctcagcccattttccagctgtacaaagctgacaccccttgtctgccagccgcgtcagccaggcccagcgtctctgcaaccgccgcccgccatccgccccatgcagtcgggcactatttgcagccgcgcggccccagactcgttccctttcacgggcatagttagtgggcgggctttgggatgcgtgttaggacattagatagcttgcttgctgcacgccgccctcttccaccgctgccatttcacatgtccgtgacacttctgtgctgccgcccaatgcctttccattcccacgcttataggtgagaatggatgtggagtggtcgagacttagggggagttgtgcccggtaaacgttgttagcgcgtcgccgacgcggagcatggcagcgcatgcgggtgcacctcggagacgaggctgaatgccaaacgcccgggtagggggttccaggcaacgtatgcgggtaagtatactcaaggtgacaactggggcaacatcggccaccgcggagctcggtaaccggcgtaggtattggtccgtaactgcgcacgcgtgttcggcggctttgttccgtttgttttgtgtttaacacacacacacacacacacacacacacacacacacacacacacacacacacacacacacgctgggtcaacgttgtagcgcgcccagggcgcggcgcatacaatgcatatgggtgccactcggggtcaggtcgttcgtcgatcgcccgagggggggttccaggctttttgcgggtaagtatgactaccggggtcgacgcggctacaagacgctcggtatcggtaggtatccgtaagtaactccgtcgcgccgtctgggcgggcttcgttttgttgttttcttttcaacacacacacacacacacacacacacacacacacacacacacacacacacacacacacacacacacacacacacaccaattacaggtacgacccagccaagcgcatcactgccgcgtgcgccgtacgcagcacctacctgaccgccacgcagccgctgccggctgacgaggccgaggtggcggcctggctcaccgccacactggccgccaacgaggcggcggtggcagcgctgaagcagcagtcggcggcggggtcggcggcgcagctgcacgtgggaagcgcattaaggcagccgcgggcggcgtcattgccgctggtgtga

SEQ ID NO: 3 - DNA, 2711 bp, Chlamydomonas reinhardtii
atggcgacccgagcagttctccagacgtttgagcggtatcagaaggagcgggtggccttcgtgaccgcggtggcagaaatggcaaagaacccgcaagtgcgttgcctctttgtgatttaaagcgcaacaatagcatattgtgctaggccagctgactgacgcggggcttcggcatgcttgcagaacatcgaggccctgcaacaagcaggagccatggcactgctgcggccgctgctgctggacaatgtaccaaggttagtaggattcagcttcatgtcgacgtgtccaacagttgggcacccagtctttcgtcgctgacacatccgcacaccgcgtgcccacagtatacagcagtccgcggccctggcgctagggcgattggcgaactacagcgacgatcttgcggaagcagtggtgcagaacgaaatcctgccgcaactggtgaggaaagggatgcattccctttggcaaaccgcgaccgcaagccgtcttaatgttttagatggtttggcttgaggacacaatccttttgtctgcaggtgtactctctgagcgagcagaaccggttttacaagcaggccgcggctttctgccttcgtgcggtggctcggcactccccagagctggcgcagtcggttattgacagcggcgcgctggattcgctagttacctgcctcgaggagtttgaccccggcgtcaaggaggcctcagcctggacgctgggctacatcgcgggccacaacgcggagctggcgcagcaggtggtggacgctggggcggtgccgctgctggtgctgtgtgtgcaggagccggagctcagcctgaagcgcatcgccgcctcggccctgtccgacatctccaagcacacgccagagctggcgcaggcggttgtggacgcaggcgcggtggcataccttgcgcccctggtcatcaaccaggacgctaagctcaagcgccaggtgcgtggcacattgcgttgcgctttgggtgcttgggtccgtggggttgtgcgtgtctgtcatcatggtatcccgtacgtagggaacagttgccacaggctaaggctcggcaactgtgggcgctgatgatgcagtactatgccgtctatgcgctgatgctattgcaaatacgtgctggtactcgcaagggctgtcagcacttcgaggcatggtggcaataggttgtcgtcagccgacccccctgcatgcacacggaatggcatcgtatgctccgcacctacgcatctagcgaccctgcgcttatccttgctcggccatggtccacctccccaacctcatccgttctcattgtgccccccttgacaggtgtgctgcgcgctcagccagattgccaagcacagcgtggacctggcagaagtggtggtgggcgcggagatcttccccaaaattctcacttgcctcaagttcccggacgagttcgtcaagaagcacagcgccacggtggtgcgcgaggtcgccaagcacacacccgagctggcgcagctggtggtcggcaacggcggcgtgggcgcgctggtcgactatatcagtgagtttgctcggggggcgtatagacggagctgtgggcttatggaatgggctcgcgggggaggccgagagggcgcttgctccatggctcgcggtctaggtcgtcactttggcaccgggtgtcgacacgggtgcaacacaggcggcctaaacatgcggtcaggcagtttgtacggaggggcagcggacaggtcgctgaacatgttgctggcacttagtcacgtacccaagcatggtgggaagatagctgctctgccaggcgcgcatttactcctgcatgcggccgctaatttccctccgctcctacccgctcgccccgcaccacaccgcaccaccaggcgactctgcgggcaacaaccggctgccgggcatcatggcgctgggctacatcgccgcgttctcggagacgctggcactgtcggtcattgcggagaaggccctgccgccgctagtgtcggcgctcaacgaggagccggaggaccacctcaaaagcgccaccgcctggacgctggggcaggtgcgttctgggactttgacgcagacggccactcttcgtgagacagcaacgctctggtggacgccgggaatgaagggcttttgtttatgcccgccggcagccgcacaccgcatgcgcagcttttaccctcggcacccgtgcctagacaccatctcactcgccccgctcttgtgcgcacgcttcgtatcccgcagattggccggcacacgcccgaccacgccaaggctgtcgcagacacaggctgcctggcaacgctggtttcgctggagagcgacggcgcctccagcgacgacctcaagaccaagtgccgccgcgcgctcaagtccgtcatcgccaagctcacgcacctgcccgcgctggacgcgttggtgcaccggcaactgccggagagcgtgatgaagatggtgctggagcaggtgggcaaggtgctggccaacgacgcggcgggccgcgcgcagttcgtgcacagcggcggcctggcggcggtgcagcagatggcggaggcgcccggcagcaagctgaaggaggcggtggagatcatcaacagctgctaccccgaggagattgtcaagtactacagccccagctacagccagcagctactagagaagctggagagcatggccgcaaccactacggcgtactaa

SEQ ID NO: 4 - DNA, 5189 bp, Chlamydomonas reinhardtii
atggggagcttgggccatgaagcagtcgcagcggcgcagttccgtgccgctgagttggcgaggcgaacagtggtaagtggggttactggtcagacatgccgggatggcatcgtgaggtcgccatgggaatggttctgggcgcaagcggagtcgcgggtgcgtgggggactgcgtgcctgtgcccgtgcactcaaacgtctgccgttgttttatcttgtcacgctttcccctcgacctatgcaccagcccgttacgttactatcttgcgcgcctctgtaactctgatgtaccatgttgcacaggaataccatagttcccgcgagggtgagcaccgcgcacgcgaccgcttgggcggccgcttcacgccctacccctgggccgacgcggcggcggcggtgctggcagatgaggtgctcgaggacgaggagctggtggtggcgctgatccgggagctgggcaggcagggtgaggagggccaggggcgcagcggcgcggccagcttcaatgcgctgggcaccgacggggaggtcagcagcagacgggcaaggacgggcaactggcggctgccggcaaaagtctggtggcagtagctgcagtaggggcagtgtacagcagcggcggcagatgggcatacaactatgaaaggatcaccagcgcaaagtgcatgggaacttgcgcggatcgcgcagctggcagcagtatcttcctttctagcccacctccctccggctcttgccttctctcttcttcccaccaggctgctctgaggtggcggtggccgcactggacctggtgctgtcacgtgccgggtctgacggggacggggccggggccgggccgggcggtctgccgccgagcaaggggctgttcgactcggcgctactggtgtgcgcggcggagtaccaggtgggttgggcgggggcgggtcaggccggtgccctgtgccaggggccaaggggccggtatcagccgcggaccacttgcagccgctggccgcgccctgcctggggccattgggccatccatctggttgtaatccgcttgctcgaacggcgccgtgcgccgtcgggccctttcacactgttcttggttccgtttgcttacggaccgaaacatctgcccctaccccctgcccaccccctcacgcccgcaggatgagcgttgtgtggccctgtaccggcgcatgcggcaggcggggctggcggcggacgtggggtcactcaacctggcgctgacagggctgtgctgccggggacggctggaggaggcggtggagctgctggagcaggaggtggaggacagcggcggcgtcatcaagcccaacagcttcacagtgctcatgatactgcaggtgtgtgtagttggagggacaagtgtacggcatggacggaatactgtgtgtgtgtgcgtgtgtgcaggtgtatgggagttgcggggcaagaggtgctgccatgaaagcagcaaagccatgcgtcatgcctccccttccagctacctgcacgcaacagcctctcagctgcttctcggacgccaagtcgttcgtaggcgctgctgcgcctccaaaccctactctgaagctagccctgggacctaaagcgatgattttgctcgtggtgcttgctgtaaatcgcaggcgtgcaactacaagcggcgaggtgcctaccgggaagccatcgacgccgtgcgggtgcggtcagcatatacatatctgtgtacgtccttgctcccacggcccacctcacgttcgcccttcgcagagcccagcgacttatcccccgcccccccacccgccctcacccccttgtctcccccaccccccgcctgccgcctgcaggctctagagtcgtgggggcggcccgccaacgaggaggtggtggaggcgctgctgtgtgtgtgcgaggctgccatgcacaaggcgcccagcttcgaggcggcggtggaggtgttcagcgcgctggcggagttgcagctggcggacagcacacgcgtctacaacggactgctgggcgcggcggggcgggccggcaggtggcgagaggcacaggtgcgggtgcggggtgcagggtgcggaatgtggggtgcgcggctcaagtggagtcggcagcaagtgtgggattgtctttgccactttggtggcgttgtgtgccgtcgtcatgtgtgtatctctgcactacactgaagttctgcactgtagctactatacagttagaattcagtaaattccttcctcccttgctcttcccctggttatgccacacgctcgtgtgtctgccccacgccaggcgctgtacattgcgatgcaggcggacgacatccccgccagcctggagacacacacagccctcatccaggtgcgtgtgcgtgtgcgtgtgcggccctatgcacgtgggggcactggggggcagtggggcggggcagccagccttgcagccaggtggggctgggaaggacaagtgggaagacgcaggccgttggtgaggcgcaagtgcgcatgctcacacggtctgcctggctgcttggccttccctccttgccttcctcttcctgtcaggcgtgtgtggtgggccgggctctggaccacgcactagacatattcgagttcctggtggcgggccgcgccgcgcacgagctggtgccggcgtccatccagacctacaaccacctcattcatgcctgccaccaggtggggcggggcggggcgggctggcgcgaagtgtgaagcgagtgagggcattggttgcacgaagcacgtgttgccgcgggtctcttgcccaacaatacgccccccgccgctgccgccgccgccaccacctactcccgccctcactaggccggcatgctggagaaggccctggagatcgcggcctgggttcagaagacgggtgtggagttcaacgacgagacgtacgaggagctgatggccaccattgaggtggcgcagctgtgggatgagaaggccatgaagcaggtgttgatgtgtgggggagaggccagtcgtgtgggcatcagagtatgcgcattgggcaaggggctaatatgcccgggcccaacgagtaggtgcggatgccggatggtgtcggggtgacaccagcccatgcacaacctgccacgtatgcgcgcgagtctgcgaaagctgtcacgaggtgcgctgcagctcccaaccccactgtttcactcccatttcgccgtaacggctaccctcctggccgtcctgcccctgcccccccacccgcaaccgcgcaggccctgaagcgccacccggctgtgctgcccaagcacctccggcccgcgccctatgacgccatgcgggtgctgtacctggaccacctggaggtagggggggggggagggcaggagggggcggttagtttagtccaatcccaactaggccaacacccagaggaagagcggggatgttacttaaactcaaggctatgccagtaaggtcgacactatgggcataggagggggcgttggcgtgtgttgtcagtgcgcggtggggcactgtcgtcgaccccaccccttgggcgcgctcatgctcggcggaacgtctctgtcgggccctgtgctgtgtgtagttcggcgccctaacccctccggcccagtcctccccaccgccccctgtccgcgtccacacacccccgcagactctgcagcaggaggagctgctggcgctggaaaagctgggcacactgggcagctgggcgcccaagtcgctcaccaagggcctcatgggcgagcagcacgagcagatgatgcgcgagcagcagcaggcggcgggcgcgggcgcgggtgccggcggcaactggacggcctcggcagaggcctccagctggcgcggggctggcgggctcggtctggatgcggaggcgtccactgcctcggtctcggtctcggccccgggtccgccgctgtcgtatcgggacatggccgcagccatgcgcgcgtccatgcccgctctggcttttgggggcggtggcggtggcggcggcggcggcggcggtggcgcggcgacggcgctggcggccgtgtcaggcgtcgtcgggctgggcggcgagtcgtctgttagctccctggcaggcggtggcggtccgccggcgggcgccccctccatgcggcagctgctgaccagcatgtccatgaagcggatagcgggcggcggcaatggcggcccgggggcagggtcagcgtcgacggcgctgtcgttcaggtgggggggggtgtccatgaatgacgcgggggttagtagttcatgcggaacgggttagctaccgtattcatgcgaacgggagggcgataggaaaaggcagacaaggtgggtcagccgcgagtgaagcggttgtgagtgcacggggttttgaatctggaggccactccagtttctgctggcctctaacgctctgccaatttcgctggtactgcacattggaaacccctgcagagcacctggcatgcggagtctgctaggcgcagcaggagcagctgtgccagactcacctactgcctcctcagccgccgccagtgcctcctctcccgccggcgcagcggcaacagtaagctcgcagcagctgggagcgggcggcggcggctccgaacctgcacccaccggctttaaccagccgcccacgtgggcgcaggtgcaggtggcggacgcggccaccgcgggccccggcggcacgccctttgtgacgcctcaggcggcgtcagtgcgggcctcggcggcgggcaccgtgccgccgctgtcgctggggtcgggcctggcgctggcggtggagcccgccaacctgcagggacagccctcggccggatcgctgggcggcacaccccgcgtgtcggcgcgcggggtggcgtcgagcagggcaaggcctgtgccgccgccggtcgcaaccgcgggatcagtgggtgccggcggactgccggcagtggccggggcgggccagggtggcggcattcatgcgagtgctggtctgctgccgctggcggacgcgggcccagcgctgggcagcccgcggggtgcgggcgggccactgccggctgcggcaggcagtcggttgcgggcgctcaatcccagtcttcaagtggcggtgggcggcccggtgtcgcatgacttcctgccatcacctttgcccactatgccacccacctcattgggcgccggcagcgggcggcggccgggcggtttgcggtga

SEQ ID NO: 5 - DNA, 34698 bp, Chlamydomonas reinhardtii
  misc_feature (18582)..(18866): n is a, c, g, or t
atgcgggtagggggcggcagtggggctgatggcgctggtgccgtgtgtgtggcaatggcctcatgtgtcgggtcggtcgggcacccctgggagccgggcgtggtgatgaggccttggtgggctggcgggtgcggcgtgattgctgcgtcctgacccccccaccccccgccccgcctgcagtcctcctcgtgcatcctgtagcgctttcccaaccatctttgcaacccccctgtgtatgtatttgtgtgtgtgtgtgtgtgtgtgtgtgtgtgtgtacctgtggcccggggtgccgcacgtgcaggcgctggtgggccggctgcaggcgctgctggagcagggggcggcaggaggcggaggaggcgggggaggtgggggcgctggcgaggaggcgggggtggcgggcgaggcgggcgggcgggtggtgctgctggcggcccgtggcgtggcggccatggcggagccggtggcggcgctggaggggcagcaggtgcgggcggggcggggcgcgggggcggggcaatgggatatttggtgctgaacggcttagcatgggtggggcggggataatgtgtgtgtacggcggggcacaggggttggtggggttacggtttgggtggggttgaggcgggtgcgggctgcgcgtgtcagcttggacgcgtgtgtgtcttactgccaagagagacacggccgactttgttgcggcgcgtggacgatcgccacacgccaaccaaccaaccaaccaaccaaccgtcacatcggttaaaaacctccgcgctctaccgctacctgcctacccgctacacacgtgccgacagggcctggcggcgctgcttcgctcgctggcggcgcgcgccgccgccgccgggccgccgcttcccgccgagtccgagctggcggcactgccccccgggtcggtgctggcggcggcggaggcggcgccggcggctgtgtacgacagcgggagccgggtggaggcggcggcggtgctggcggctgcggtggcggcggtggcggcgcgggggccggttctggacgacgcgggtgggcggctgctgcgggagctgcttgagagggtggtgggtgagtgacggcgtgcgtgtgtgtgattgtgtgtgtgtgtgtgtgtgtgtgcgtgtgtgtgtgtgtgtgtgtgtgtgtgtgtgtgtgtgtgtatatgtgcatgtgtgtgtttgtgtggagtgcacccacctcatttccctccccctgcggccgcccggacggccgctcatgtggtaatgacttcgtctgcagtcttcggtgcatcctgtaccgcttttccaaacacccttgcaaccccctcccccaattcaccatcaccgtcatcatgcctgaagtttcctccctccacccttccccacccttccccacctggcctgctacagccggctactcgctggtcgcggccatgggtgtgctgcagcggcgagtgcacggcgagctggcggcggcgctggcggcagtagcagcgcaccagcccgcccgactgccggcgctgctacagccgctggcggcgctgctgctcagcctgtcgctgcagcagccgcagctgcagccggacggcggcgtgggcgcggcgctgggagatgcgggcggcggaggtgaggggcgggcgggcggccgcgcctgttgccgtgccagggatacggctcgccatctgtgtgtgtcaacctctgtgtcctgtgtgtgtgtgtgtgtgtgtcgacctacgtgccatcccccacctgtcatccggtcattcatccacgccgccttgcaggtgcgggtgcgggtggcggcggcacggcgctgctgccggactcggaccccgagcagcaggtccggccctgggaggtgtacatagagctgtggcgggcgctgctgctactgccggtggggcccggcggccgcctgggcagtagcagcggcggcggcagcggcagtagcagcggcggcttcacggccgagatgcaggtagggtggggtgggggctgtgtgccgtgtgtttgtatgactagcatgtgagatgggaccgggggaacggcgtgggccgtccactccatcaccacaccagcgcaatcttacacaaggacacaggctgggctgtatgtatgccttcattcttttccttgtgctcctccctaaaacacacgctgcggtgggcccgtaacccgcggcctgcacacatacccaccgccctcgaatcccaaccccgcacacccgcacccgcacccacacccacacccacacccacacccacacgccttcgctacaacccttccgccctccccccgaaatgaaacaggcggagctgtgccgcacctatagcgccgccacccagcgccgcctgcgtgccgccgtgtacgacgccctcatatccgccgtactggacgccgcccgccacttggacctgtcgtacagcctgccgccgccaggcggcacgggcggtacggcaggtgccggttacggtgatgatggggatgatgatgcggcggttggcggcggcggtggcggtttgacggttgtaaccgacctgtacggcggcctggtggccaacgacctgtacgacatgatggccttcttccacatgcgcggtgaggggctgggtgggggggggtactaccgtatcgcgtggggtttggccatgtggggctgcgtctttggctctgtagccggctgtgaggttgtgagctgggatgcaggtgctcctatgccgcatagccacctggtcatcagcgtcgtgctcatcctcaaacccctctcccccccttatttggtaccggcttcgtcagcggtcttttgtgcatcctgtaccgcttttccaagcatccttggcaacacccaccccctatcccctcaccctcgcagattttctgggcgagctgctgccggccgccgggcccggcctgttcgcacgctgggcgctgccggcggctgaggcgctgtgcggcctggcggcggagcggcccctggtcagcgccacatacaggtgcggaactgcgcgtgtgcgcgtgtgtgtgcaggcacgtgtggcacgctgggcgcatgtgtgttcgtttggctgtggcttgtgctgtgtgtgtgtgtgtgtgtgtgtgtgtgtgtgtgtgtgtgtgactacggtttccatggtttttctgccagatcacgtgaatcgtgtatctggtataaccaacgacagggctctcaatcgagggctgccgtgacctggcgtttccccggcagagcgcaaccagctctggagtccacagggcaacgcactccgacccttcaccgcgccagtaatccttgcggaattactaccggtgtaacaacctcagacccagcgggcgagctacctcttaaaaaccaggcgggcagaagacaaaaaacagcaaacataacaaaacacgcagcacgcgacagcacgcgaaagcacgaccacagtggctgcggggctgagtcctacgacccggcagcctgcacgacctcaaccgcaacctaaccagctctcgacgcaagggcagacaatgcctaagggcagccacaaacgcgtctggccactaggccggtccaggccgtaagacccggggtgttgcagcacccaatacaccctctcaggcattaaaaccccgcaaacctggccctgctcccacgggcgtaaaacaaaagacccttcgcctgcccactaagctcccccgctgaccctctcgtatgccactgcttcagtggctcatgttagtgctcacgcgcttctcctaagggctgatccctttcaagcctccagctccatagcttgcggcatcgcgcacagcatttcaccgttcaccaccgccaggatggggtgagtggcgtcaacaccatcccaacccttttggggcacgccgagctgcgcgaactgcatcagccgcgaccagaagtccgcgactgcacgagcgcacgcaagctcgacggggttgacgcctggctgcggcggcgtcagctgtgtgggcgggatctcgtcaagatcgggttccgcctccgctgcacctgccaccgcagcctcgggagctgctgccgccgccgtctgaattcccagggccgctgcggcgcgcgtcatcccgcgcagccgcacccggccatgttctgtggcggccagcgccgccatcaccaccacgtcccaaacacactgctgaaaacccggcggcgcctgaaccagccacagctgggcttggctgatgggagccggaccggggttgtgtgcgttgatctgcgccaccacggccttcgccaccgcgtgtgtgtgtgtgtgtgtgtgtgtgtgtgtgtgtgtgtgtgtgtgcgttgtgtgcgatgcgtgtgcgtgtgcctgtgtgtatgctcctgtgtgtgcgcctgtgtgtgcttcgcaaggcgcgagtaatcatgaatgtaaccctcccctctgctcctccactcgtcctcctcctgctgctgctgctacccagtctggccaaggtggccatggatttagcagaacaggccggagctctggcgcccccacccgccacacccgcagccgccacagccgcagccgtagccgcaggaacccgtcgctacggtggcggcggcgcggggggcgcaggtgcggcggtggcggagcaggaggaggaggcggacgtggcggcggcggcggcgcgcgcggcggcggcgacatcggagctgttccgcggactgctggcggcggtggcggcggcgtgtccgcattacaaggtgtggcgctaggggctgctgtttgtggttcaagggctaggctgccccccgaccctgacctgtccggcccaaaccacctcatgcaccgcttttccaaccatctttgcaagcccatctccttcctcacttaagcgtaacactccctcgcactgcctcactccttcacacacacactcggcccccacaggacgagctgctggtgtgctgcctgcagctgctgctggcggcgccgccgcacctgctggcagcagcagcagcagcagcagcagccggcagtagcaccagcactagcggcggcagcagcagcaccagcagctacagcctctctgctacagccgccggccagggtctggcgctggcgctgcggctggcgctgccgctgggactgcagcaccttccggtggcggcggcggcggtggaggcgctggagcggtgggagcagcagcagccggcggcgctcagggtaggggcctggggccgggccgggttgagcggccggcgccctcggttacgaccggtcgcggatgctgtgcccgtgtgtgttaggtcgttcgcatatggaagttgtcggttgtttatgcaagtgttactcggctcactggttttgggacgccgcgaaccgccgccaaccgccatcagctgctgtaccgccgccccatccccaggccgcgctgccgtactttgtaccgctgctggagccgtacctgtccgagcagtccggcgcggcggcgctgcaggccgaggccgacaacatggcggcggcggcggcggcggagcccggcggcggcggagcaggcggcggcggcttcggggagggtgctaagagcggcgtggcagctgctcgcgccagccgcgccgccaaggcagccaaggtgcggcttggttttgttcatgcaaggatggttgggaaagcggtacataatgcacggaaccacgggggggggcagctcccggtgttggggggtccgggcggctccgggccctgcggcgtgtgcgtgtgcgtgtctgaccaccctgacagccccggccgcgctgccagcgctggcaactccaaccgccgctgggtctgcctgcgtgccgcctgacccactcgctcctatttcgttacacacacgccccggcggcggccagtgggggcatggccgttggcagcatggcgctgacttgtgccgcatggcgctgacttgtgccgcatggcgctgacttgtctcttgtgccttcctcgaactctccctccctcctggttctgttgggctcgggctgatgaagcccaccctcccccgccccatccaatattacatgaatggctacacacacacacacacacacacacacacacacacgcgcgcgcacacacacctgcaggccgccgcgccggacgcggcctccgctctggagggcctgcagtgccggctgcagctgtggctgggccgcaaccccgccgccgcccgacacctggtggcggtggacctggcgtcgctgctactgccggcggcggcggctgctactgctgacaccgcgctcggcagtagcagcggcagtagcaacggcggcgtggtcgggcctgcggcgcagcggctgctgcagcagctgccctgggacacggactcgaccaaggtggcgttgcgggtggcggtggctgtagcagcgccgccggcggaggccgccgccgacggcggcgcggacggcgcggcccccgacggcagtagcagtggcgatggcggctggagccgagtggtgttgcacctggacctgctactgccgcatgcggcgcggctggcggaggagagcccggcgccgcaggctcggtcggcggcggcggagctgctgcacgcggcggcgctgtgggtggtgagcggctgtagcggctctgcgtccgcgtgtgccgcagtggaggtggtacagctgtaggggagcaggggtgccagacgcttccgtcactcgtaacaagaccgctcaatcacaacgaaatccgcaccgccgttgccgtccgcaccattaccgttggcctctccgtgtcccttacatgtgtgtatatgtgtgtgtgtgtgtgtgtgtgtgtgtgtgtgtatgcttgcaggtgggagccaacgccgcggtgcctgaggaggggcagggccgccgtgactacgagtgagtagcgctgatgggagggagtgggcaggcgcggagctggcccggacggcggtctatgcagctagccccacgtctcaactccacttccccactccttcatttctcccacacacacagcgctttgttttcctaatgcttttaacacacatactgtacacacacatatacgcccacaggcggcgcgtcacgcgcttccagccgctgctggcgcggctgtttccggtggtgctgcggctggcggcgggtcccgagcccctggcgcgtgagctgttccggcggctggcggggcagctggtgcactggtacacgcggtgagggagggggcgagggggaggggagggggagggggagggcggaattttggggcatggctactgcgcattgcgtagcgccccggggattgacagtttagcttgccgtttgaggggctacactcgaaagacctctgctccgcttcatgcttgattgcaatcttactccctgacccgcgccctcctcccttcgtcccgctgcaccccaccactgcaccactgccccaccccaccaggggcgcgcggcgcgagggagctgaggccatggcgctgctggaagccgtcctggctggactgtgtggcggcggcggcggaggcggaggcgggggcggaggaggaggcgggggcgggggcgcgggaggaggcgcggggtcgctgcgggacctgtgtgcggcgctgtgcgcggagtggttcacgtgggctcagaagcagaacctgggcagcggaggcggcggcggtggcggaggcggtgaaggtgcgcaggtactccaacccaagcatgtgcctcgaccttcctatgctcctttgcccttcccatgcaccttcccatgcaccacgtagtcgtgactgacgcaacctaaccctattgtgtgtgtgtgtgtgtgtgttcccgtgtgttcccgtgtgttccgccgccagccacctcctctgacgccttcgtgtcggtcaacgccgccagcctgctgcgccgcctgctggacagactggcgcagcccgaccccggcgtgcggcgcggcgcggcggcggcgctggcggcgctggcccggccgctggcggcgccggcgctgggcggcggcgcggcggcggcgggcggtgtgctgctggaggcgctgtggctgctggcggcggcgttgaggcacccgctgggtaggcgtgtgtatggcggggagtttgcaaagatgtacaggatgcaccggtagggtagacgcgcattccgcggggaacggagtgattaaaccccaacgcccaatcacgcagcggacgagggcggcgacggcggctcctcctcggctacagccgccgccggcagtagcagtagcagcaatactgccaccaccaacaacaacaacaacagcggcggcggcggcgcgggcggcctgggctacggccccgccctgtcccgtgcggtggcggcgctggtgcaccactgcctcacccgggagctggcggaggagctcacgcggcccctgcccggagaccccagcctgctgctactgccggctgcggctgctgctgctgctgctgctactgcggggaggggtcgtgggtgtgctactgccggggctgccggactgagcgcggcggctgaggactatggcgacggcggcccggacgcggacgtggagtggggcgaggaggaggaggacgcggaggcggcagggggcggggcaggggatgtggagatgcgggaggcagggcagcagcaggggcagacccagggcgggctgggtctggggctggggctgtcagctgcggtggtggtggtcccgccttacagcacactgcagacgctggtgctgtggctgtggaaggtgcgggggcgggggggggcggtttgtgtgggcccgtgctgtgtgtgctgcgtgtgctgtgggatgtgcggggcaccacctgaccaccttgtgcttaagcgcgggcatgcgtgtcgtgtggaggtggcgaccccaccccccggccccttccgtgccatcgccgtgtgtgcctttgcaagtttgcggccgaatcccgggcgttgcgtgcccacatgcttcagggcacgggcggcctggcggcggcggcgggctcggctgcggcgcggcgtgaggcgatgcggctgcaccacaggctggcgggggcgctgctggaggtccgcgcacaggtggggggcggagggggcgtgggtggggggattggggcgtggggggttggggcgtgggggctggggcgtagccgggggatgaagggtagataggaggcaggggacgtagccatgtcaggtcccgctagttatgcctacgccaacacccaaacacatatacagccaaacagccaaacagccaacacccaatcgtcaaacacccacacctcgcaggaggaacgcgaccggcgcatcaccgaccgcggcggcggcggcggcggtggcccccacccggcaccgggggcgggcgggctgctgtcccatatcctgatgatggggggcggctcacaggagggggaggaggaggaggacggcttgggcagccacggagcgcacggggatcacggcggcggcacgggtgctgctacagccgctactgccgctgctgctgctactgccagggtggagcacgcgggccccgcctgtgcggcgctggcggacctggggcggccgctgggctacagcgcctgctgggtgagctggcgcgtggcggtgcgctacagccgtagcggcagtagcagcagcggcggcggcggcggcagtagcagcgacagcgcgcggctgcggatgctggtgccgttcctgctcacgcagccgccggcggcggcgctcacggggcccggcggcggcggcggcggcggtggtgcggatggcgcagaggcggcggcggcgggggctgctgcgcggtgccgcgtgtggctgcggtctgtgacggcggccctagactggatgcgttgggccctggaccaggggtgcgcgggggcgggcgaggctggggcaggggcaggtgcggagaggttggggaggttgaggccaactgtgaccgcaagttccccccaccgctgcggtcaccgtcatgggcgctggccgccagtggctgctgtgccacgaggcgcttgcagagtcgagtctgccagttcgtctcccgagtcgctgagttgccacgtgtgcctgtggctgtgtgcctgggacactgtgcctgtctgtgtgcctgcttaccactgcctgcctgcgtggctgtgaccgccccggccgcctcccataagtaatatcgcttgcaactaatgcctctacctgtgctccgctagtttagcttggtttggattagtttgaggctggtgcttacaaccccctccatacccgcactcgccccccccccccacacacacacagggtcctactggccgccgaccttcccgacctagtggacatggcccgggaccgggccgcccgcgacacacaggaggcggcggcagcagcagcagcagctacagccgcagcagcaggagtagctggggaggaggacgaggcagaggactggagaatgcgaaggaggaggaggcgcggcggcgcgcccccgcagccctgcgccaccctgcccgactccctgcttgagctgctgtgccagctgccgccggtggaggaaggcgtgagcggcagtagcagtagcagtagcagcagcggcgcccagggcggcggcagtagcagcggcagtagcagtttgctgctggccggcgccgggtgccgcggcgccacgcgggacgcctgcctgtcgctactgcggctgatgcaagcgctggtggagctggaggcgcaggctgtagcagcagcagccggcagtagcggcagcggcggtagcagcaccggtggcggtggcgctgctacagccgccgctggcgacagcggctgcgactactgctgccccagtgaggcgctggtgccgtggcgggaccgcgacactgccaatgtggtgctggcggcggcgctggccccgcacgtggtcggggcggcggcggcggacggtgagggagggcggtggcgggcatgcatcgggcttggagtgtcgagggattgcgcttgggctgagggatcccatgggctgcacatcagctattacgacaccagcggctgttggagctatcgtagtcttgtgtaagcggcttggtcgtcctgggcatggaatcatcaacaggccatgcacagggacctcggcagccctctgccggcgttgttcagcccggcgacacagcagcagcaggacagcgacaggggtcgccaaagggcaggaacggcgctgccagccctgccgtcgccgccgcacgaggtagcggtgccagcggcccagggcaggcgggccacgcagggcagcaaacagcggcagcagcagcagcagctgcggccccagcccgggccagacctggcgcatacgttatgggacctggcatgcagcatcttggacggggctaagcgtaacagccaaggacagccttcccgcaactgggcacaagcttcaagtccttggcgtttatgcttggccttgcccaagatgctgcatgccatgccccataacgtatgcgccaggtctggcccgggctggggccgcagctgctgctgctgctgccgctgtttgctgccctgcgtggtccgcctgtcctgggccgccggcaccgctaccttgtgcgcgaagggacgcaggaacatgaagcgccgtcgccatcgctgaggggtccatcggagacgccagtgccccatcccaaactcatcaatccaattaatttcatcatgcagctcacccaacagtgccttggcttaaagaatccattgttggtgttctcgtttttgacgtatgcagtcgcggcgcgacgtgagttgacggcgacggccgcagcgcttgccggcgctgccgtgcgtgctgccggcggcggcctcggacacggcttccggcctgccgggccaggcatgggcggcagtagcagcagcagcagccatgcgggcacgagcagcggcagtagcagcaggggcgcggcggggccgctgactgccaccctggagggtgggctgcgtgagctgctgcggcgcacgctcgactcggctgctactgccctgggcgctggcggccgccccggcatggcggctggtggcggcggcggcggcggcggcggcggctggggcgaagccgcggaatcgatggaggtggatgaggtgggtggcggtgaggaggaggacgaggaagaggaggacgaggagggaggtgaggcggaggcggctgccctgggactggggctggggctgcgggcgtccggcaagagcggagctggagagccggcggacgcaggagcagcggcggacgaaggagcggcgacggcgcgtgtggaggcggcggcggcggcggcgcatgtggaggcggcgcagcggcgtgcgacggcccgggcgctgcggctgctgggcggtcgggcggccatgctagcaggcgacccactgcagacgtccgccttcctgacaggtgggggcggtggggctggcggtgggggtggtggatggcggtggttggggtgggggtgggggggctgcggacagggggcgagtcaagggtgggaggcgcgcgaacggacctgctgtgatggggggcggggagtggcgcctgaacagaggcgtgtgtgggcgcgcttgctgcctgtgaacgctccttttccccctggtggacaggcctgtccggactgctggcgctgccctggcccgccgcctccacgaccagcggcagcggcagcggcagtggcagtagcagcggcagtggcagtagcacctccctggtgccggagccgctgcgggtgcggctgcggggccggtgtctgcagctggcgcggcggctgccggcgggcggcgaggcgtcgccggcggcacgcaaggccgccacaggtgcgaccggggtgcacagggagggacctcgctgtggtggtggcggaggaacgcggcggcacggccgtccgtcttcttgcagctgctcgttagtcagttccgccacacaaccattgtgcacactcacagctcacactcatactcacagctcacagctcacacacacactcacactcactcacacacacacacacacacacacacacacacacacacacacacacacacacacacacacacacacacacacacgcacacacactcacactcacactcacactcacactcacacacacactcacactcacactcacacacacactcacccaaacctgtctcccccacagacgcgctcagcctggcgctgcagctgcagctgcccgccgccgacctgctgcacgtgctactgccgctgccgccgccacccggccctgctgctacagccgccgcctgtgctacagccgccgcctggaccccagcagccctggagcaggcgcagtcgggcgccgcggacggggccgtgttttacgacaacttcagggccgtggtgaaccgtgccctgctgttcgaagcagacacggccgtacggcacgtgatgaccgccctggcggccagcgcgcagctgctacagccgggcagcgctacagccgccgcgccagaggcagtagcggcggcggcggcggcggcgctgcgtgctacagccgaggcggtgctgggcggcgtgatggagagcctcatgcgctcccgcgccgccgccgatgccgccgctgctactgccgcggccgctgctgccactgccgcggctgcagcctctgccggtgccgcaggcgccgccgcctcgcagggagcggcgggcgccacgcaagccgcgcgcgccacccaagccacgccagccgccacgccagccgccacgggcgcgcccgctgcgcccccgctgcggccgcccccgccctccttgccccgcgccgtggacctgcacctgtccgccttcaccgccgccctgcgccgccacctgcccctggcggcgccgctggcggctcgcggctcgccgcccgagggccgcctgcttctgctgcggctgctgcggctggcgctgcggctggacgcgccggggctgctacagccgctgctacagccggcagcggcgcatggcgcgggtgctgctacagccgcggcgccgtcctcgtcctgcctggccttcatcctggactgctactgctccatgctgtcaccgcagcaggacgccaggtgacaacgctgaggcggggcagtgtagctgctagctgctgtgtcgatctgtgcaggctctgctttatggccgttcgcaaataggccactcatgtcctcctgcgtctcctgccgctcttgccgctccttgccgcccatgtccctcacccgtttcattgggcccgggcacataaagcccttctgtaatgaatcacgcaatgcatccccccccccccgccctcagcgtcacctggacaccggcgctgcagctactgccgctgctggccgcacagctgccgccccagcacgcagtgctgggccgcctgttcacactcggcagtagcacgggcgccgacggcagtagcagcagcagcagcagcagcagtggcgttaacgctgccaccaccggcgccgtcagtgcgctggtggcggcggtcatcccgcccgacagccgccgggagctgggggacgccgccgccgccgccgccgcctcgcccgccggcgccgccctgtcacagcggctacacgctctaatgctgacgctggaaggactggcggcggccgccgccaccgaagccgcagtagcagctgctgctaccgccgccggtgctgctactgccggtgctgctgctactgccggttcagcggccgcagaggcgggcgcgggcgcggacgggtctgggtctgggtctggggcgggtgtgcgggcggctgcggcggaggcgctcctccgtgacctgctggtggtggttcaggacatgggcggcggcggtggcggtcacgtgctgcagagccgcctggccgccatgttcacacgcgtggccgcagcggcctggctgggcttccccgccgttggtgctgctggcggtggcggtggtggtggcggtggcggtggtgctggtggtggtggcgatgaggagtcggggagccaggaggaggcggcacaggcggagatggaggcggaggcggagcgcgcgcgggcgtggccgggtgcgaggctggtggcggcgtgctggcggtgggctggcggcggcggcggcggcgtagacggtagcggcggcggtggcggcggcggcgcgttgaagcgggagctgcggctggcgctgctacagcacgtgctattgccgctgctggcggcggcgccgaccgggttccgcgtctggtggtacggcagcaacgtacggcggtttgtgcagtacgtccagaaaaccgccgccgccaaggccgacccagtggcggcggcggcggcggcggcggcggcgccggaggtgctggcgggcgcgctggcggcgcggtgtgcggctctggtggactcgtgggtgtcgtacggactgctgcggagtatgtacggcacgtgcagcgcggcggaggtggagcgcgtgtggggcaaggtgggtgggtgggtggggctggatgtgggtgggtgtggatgtgaggctgggagggtgtgaggctgggagtgtgtgtgggggggggggctcatcaattgggcgatgcatcacccgcacactcacattcacattcaaacgtgtgccaacaggccaatgagcatctggcgccggccagtggcggcggcggcggcggcggtgcgttgaagaacggcgtggtcatgtcggcggcgtgtgcggaggtgtgccgcccgccgccgcccgccgccaccaacgcggcggggctggagctccgggtgagaaggcgcgcgtgtggaaggccacgagcctttgtctgtggcgtcggcattagggcgagttgggtcggggctgctttccatttcgtggggtgcgtgctgctcgcccccagccaagcacaatgcagcccaacctactacacgtgacactcaaccgcgtcggcgccgcccgatgcacgcaccccacttgcccgcccaaaggatttggaccgggacgtgcgctgcgcggcctgggccgccgccgccgcgctgctgctgcgcacccagtcgcgcgcggccttcttcgccaaactgcttagaccgggtgcgtggtcgggtgggaggtcgggtgggaggtgcgtgggaggctgggtgggtgggtgggtggtcccccaggtgaggggacgaacggtttggcggtgcagtgtgttcttatgtggtgagtaggtgtagttattatgcagtaggctgtacgtcgggacggctggatggaagttcccttggcgccccatggttgcactccttgctgctgcccatcccctcgtgcgctgcacaacctgaaggttccccaccttcacacccagtacacgtgcgctcctcacaacacacacgtgcacgcacacgcacacgcagacgcgggcggtggcgctgcggctgtgtggggcgcgctgctgcggcaggaccccgccttcatgctgcccaccgtgctggacgagggcgcagccggcggagcaggggtgagggggcggggtggtggtgggggctgagtgtgtgcgtgtgcgtgtgtgtgtgtgtgtgtgtgtgtgtgtgtgtgtgtgtgtgtgtgtgtgtgtgtgtgtgtgtgtgtgtgtgtgtgtgtgcgtgtgtgcaagggcagatgcaggtgcagttgtgcagttgcgggggtgggattgtgcattgcaatgatggagcgcggctgcgtcaacacggttccccgggcccacacacgcagccggccacatgcccttgtgcccttatgctctcatctggccattatgcccgccttccctcccgcccttcttgccctgcttgccctgctccatcccccgccaggccgcgggcgcagagaggcgcaagcggctgcgcaaggagcaggaggcggtgcgggtgggtgtgcctgcccgccctccctgcatgccaaacccgtccaacccgatgcaaccgtatggacagtgacatatttacaatatccaacgccttggctcattttcatttccttttccaactaattttttcattttcatttccttttccaactcttttcattccgattccatccaacccattccaccaaaacttgcgcatcatccgtgatcgcaccttgacttgatctgacttggcttgacttgacttggcctgacttgacttaatttggcttggcttggcttggctgggtcccgcccgcaggagatgtttcggtcgctgcgccgccaacgtgacgccaacgcggcctggcacgcggcggcgacgctggcggcggcggcgggcgggactggcggcggcggcggcgcctccgccagctttatcatgggcaccctcggcggcggcggcgccagcctctactacactggcggcggcggcggcggcgacgtcgccagcctgacggccaaggtgtcggcgtcgcagtttgatctgggtctggcgtcgacgtcggccagcctggctggttcggctggctttgccggcggcggcggtggcggcggcgccgccgccgccacgccgccgccggcttcctttgcggcgtcgggcgcggcagggccgggcggcaaggccggggcggtggcggcagtgccctacacatggagtctcagcggcggcggcggcggcggtgctggtggtggcgatgacggacggccgctacccgccgccgccgctgcagccgttgacccggcggttgggctggcagcggttgaggatgaaaacttcctaaccgactccctgacctttttggacgacgagatggacgagcacgtgtgcatgctgccgctcgtccagctgatagagaagtacagcgacccgggcagttgggacgccgcgaaggaggcggcggcggcggcggccgcacgtgccgcgctgttccccgccgccagcgccggcggtggcagtagcaccagcggtggcagtagcacaggtggcgacgcgcccatgccttcttggctgcagacgctgtttgaggcgctcaatagcgaccacacgcccaggtgcgtgcacgaccgccgccgccagcaccggcacagctgggtaccgctgcaccccacacggggggctctgcgtgtttccctccctccgcgttccgcgacacgcacgcacgcacgcaaatgcacaaacacgcacgcacacgcacggtgttttggccgactcaacaaatcggaacacaactcaagccacaacacaaaacacaagactcctcacctcgcccacgccacgcaggtacacgcggctgttcctgctcaaggccgtgctgcatgtggagtaccgccaccagcaggcgcgcatcgcgggcacacgccgccgctaccaggcgcaggctgtagcggctgtagcagcaggcgcgggccggggcagtagcagccagcgggcctcgcaggcggtagcagcagcaagtggtggcggtgtgggcagcatgcgtctgagcagcctgcaggctactgccgccgctactccctcggcgagcctgggtgttggcaccacacaggctacacccggcggcggcagcgccgcagcagcaccgcagcagcagccgccacagccgccacagcagccgctacagcctgcgggtgcggacgtgggcccgggccaggcgcggctggtgtggggcgccgggggctggggctgtgtggaggcgggggaagacgacgacctgttgtttgggagcgacccgctggggacggctgctactgccggccggggcggcggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcctgtgccctctgctcattgggcccgggcacagaaccctgcctacctgcctgcctgcctgcctgcctgcctgcctgcctgcgtgcctgcctgcctgcctgcctgcctgcctgcctgcctgcctgcctgcctgcctgcctgcctgcccgcccgcctcccgaatcctctcccccttcccaccctgcctgcctgcctgccctgcagttctcgaccaccgtgtttgctgtgtgggccgagcacttcttccccgcacttgtggcggcggaggcgctcggggccggaggcggcaatgcagccgccgccgccgccaccgccggcagcccggatggcggcgacgcggcaggcccggtggccggcggcggcgaccgacacaaggcggctgcacggggcggtggggcggcggaaggcggcgagagaagcggcgaggaggatgatgaagatggggaagaggaggattttgagccgcagctggcgcagcgccggcctgagggcgaggccacgctcacacagctgcggcgccggcaccagcagtacggagcagccggcggtgcaggcatgggtgcagcaggtggggccgcggcgcagaggctgccaggcatgggcgctgtagctgcaggcgctgctacagccgccgcagcgccaggcggcggcggcggtggcagtggcagtagcagtagcagcagttgcgggccgggcacgcttagtatcgtgacgcggctgctgatccagaccattatgagttggaggaagctggcgccggccggcagtagcagcagcaacagcggcggcagcagtgttgacacgccggcggcgggtgctacagccaccgccacggaagacgctggcggcggtggcggcggcggcggcggcctgccgcgtgggccgctgcgcgaggcggcggagcggctgctgcggcgctgtgtgtgtggctgcctgcaccccaccagcgcagaccagagccgccacaacgccaaccacgtcatcacgctgatgtacttctggcgccgagccggcgtgtcgctgctgggtgcggctggcggcgggaggagaggggagagggggcagagggcgaggcggcggggtggggggatggctggatggctgggggtggttggcttgcgcgcgtgtgcgtgcgcgggtgtggtttcgcttttgcattgcggtcgcgcgcacgcctaatgcgatttgcagtcgaccgattggagactgccacacccaccactcctgccgctcctgtcgctcctgtccggctgtgcaggtcgcgagctggtgccgctgctgggccggcggctgccccagcggcagcgctgccagggcctgagggtggcgcgggcggcgctgggctacggccaggaggaggcggtgatggcgggcgaggcgtgagtgtggggggggggggggggccttgagggggggggccaagccctggtgctggggtggttgtggcctttcctggcctggtgggggtggggcccgtcggcctcaggccctgttctacctcctcctactcgggatcttggcatatccgactcctggggggggggggccccttacgtgtgtcaggccctggggcgggctgcgggctgcaatggccacttccccaccttgatggggccttcccgggcggggtccagtgccggcccctgccggccccgcgctgcagcacccatcccgcttgacgccttgcgcccacggttgtcctcagccgccgccttctttacggcctcccgtctaataactaccccacctgcatatcgccaaccgcctccgccgccaaccgccaacccccatcccatgcgcctattgttctcccaccacccccacccccccacccccaccccacacacatagggctgcggacatctggaaggcgctggttggcatcaccgcctgccgcccgccgccgccgccgccacacaccaccagggcctcaggagccggcggcggcggcggcggcgggcacgcccaccaccactacaccggcggcgccgccggcgcccctcagctgtctgtggaggcggcgccgctggggcagctgttgggcctctactttgccaaactggcggagcgggaggcggcggcggcggcggcggcggcggcggcgggggacgctggtggcggggcaggggcggcggcgacgcccggcgcctggggctgggcgggcgctgccgcggcggcggaggcggaggaggaggatgagggggacgtgggcggcgggggcggaggcggactgggcctgacggctagggcgaccaagcgagcgcggctgtcaggaggtgagaggccatgtgctgcgtgtgctgcgtgtgctgcgtgtgggaggaggccagggcaacccacggccgccacggtctgtgcagattgctagggcacgacgaatgttggtcgctgacgccgtgtgtgttgtgtgtgttgacgccacggcggcgccgcacaggctcctcgctcaaggacaagatgcaggacatccgggtgggtggaagtgggtggaagtgggtgggtagatgggtggggggtgggtgggggtgggtgggtgggtgggtgagggggccgtcagtgcacaacagctgacggcgttgcaagacgcgaggacttcctctcatctcccgccgtcccccatcgtgctgctgcgcctgtttccaagcacacacatcccatgccatgtggactactatttcaacacacaccacacaccgcacgccgcacgccaacccccaaaccctcccccctcacctcccacccctacaacagtcggccctgcgtgaggccaccgacggcggccgcaactgggaggcggcggtggaggtgcttctggggctgtcgcagccgccgccgctagggcacccgcccgcagccgggcccctggcgccagagctggtgagtcgggggagggggggggtggggcgggtgggggtttggcggggcgggaagatagggctggggcggaggggcgggggctgtgggttacgttgaggggccgcctgaggccgcccaattacgcacgcgcacacatgtgcacacacaagcccttacaagcacgtggaggtgttgggggcgctggagaatcacacacgcaatgcgcatacatgcgctcacacaggcctctcctacttagtgctgttacaccaccacacacacacacacatgcacacacacacacacacacacacacacacacacacacacacacacacacacacacacacacacacacacacacacacaggtcaagcggctgggcgtgttgcgcgacgtgcgcatggccgatgcgctcctggtgctcaggtgattgtgtgattgtgtgtaggcgcgcgtgtgtgtgtgtgtctgtgtctgtacgtgtgtgtgttaaaaaacgaaacgaaagcccgcccaatgacgcgacggagttacttaccgatacccaccattttaccgagcgtcgcgtgattgtcgtgacccaggtagtcatacttacccgcgataagcctggaacccgtgtgtgtgtgtgtgtgtgtgtgtgtgtgtgtgtgtgtgtgtgtgtgtacgtgtacgtgtacgtgtgtgtgtacgtgtgtgtgcgtgtgtacgtgtgtgcgggcgtgtttccctgaaagctgggaacccaacaacaccgcacatgccgccaccaacccccttccccgcatccggctcccacaaatgcacacaggcgctgcgcgctggtggcgtcgcccgccgccgcccgcggcctcttcatcgacctgctggcctcactggacaggtgggcgtgtgtgggtgtggcgcattgtagtgcagtttggtgtgggtcaacaaccgcgcgcttggcactgcggcgtgcgtgtgtgtgtgtgtgtgtgtgtgtgtgtgtgtgtgtgtttgtcagccttggccgacgtgtcgtacctcgccctcgtccgtacgcatccctttcacggccggccactgctgactgcccccccccacacatacacacacacacacacacacatacggtacacgtacacaggctgccgctgcgctccatgcgagtggaggcgcaggtggcggctctggagctggtgcaggtggggtgggtggggagggctggggatggggggatggggcgtgggcgtgcgtgtggggggggtgcacgacaacacacatgcgccgctacagccctcactgcacctgcacctgtccctgcactgccaaccccaaccccaacctcaaccccaaccccacctccgcacaggccctggctccccgcgctccgcccgagcagcttcagcggctgctggcgctgctgttgcgccgcggcctggccgccgcccccgaccccgccgcccgcctggccctactgcgcctgtgcgccgcgctgtgggcgcagcgggggctggcctggccatcgccgcccaggcagcagcagcagcagcagcagcagcagcagcagcagcagcagcagcaacaggaggcaggcgcagctgctgctactgccgatgcggcggaggcggcgcggctgctacagccgctgctgctgccgctgctggcaggggcgctgggcgacggggacccgggcattcgggcggcggcccgggggttctggcaccggctgctgccgcccgcgccggcggagcgactggcggtgagaggcgacggtcgtgggagcggagcgcgcgggccggggtaccgatggtgttagtggtgatagtggtagtggtggtggtgggttgtgcagactgtgtgcctgagtgccccagtgctgtgttgccatgtgctgccagtattcctgcgcttcttcccaggttgacgcccatatgtgccgtacgtctaccccccacaggcgctgatccgtcttgcctcggagccggccctcacgcccaccacctccaccaccgcctcccccaccgccacagccctagccgccgacgccgccgggcggctgcagcgcggctggcccggtctggcggcggggctgctgctggcgccctccctggagccgggcagcgccgccgccgccgccaacgccgcggctctgttcaccagccagccctatgagtgcgagttcagggactacacacccagcctattcgcgggcggcggcggcggcggcttcggcggcggcggcggtgcaggaggcggcgggtcgctgtctctgcgcacgcccgcgttcatgatgtcacaggtgcgcgacggctgggattctttccaagccactggctggtgtggtgcatggttgctgcctggactcatacctgcgtgcagtacatgcgtgaatgcacttgatgtacaatcgacacagcacggtttagaatttgaacgcacacgaacgctgttgcaggacgcctcgcaaggcggcggctacttccgtggccggcagcgcccgccccgcggcctgctgcgcgccaccgcctccgtgtccttcaaccccacagtgtcgttgtcgctcaccggggccggcggcggccccttcgcagcacccctgggcggcggcggcggcggcggcggcggcgccagccaggcctcgggcggcggcgcggcgttccttgggccgtcactggcggcggcggcacagggcggcggcggctcgcagcagggccttgccggcgcgagccaacagcacggctacagcctgggtgctgacggcagcagcggcggcggcacgagcggcggcgacgtcgtgcgtttggtggctcgcagccgcgcctacgtcggcgggggcaacggcggcgccggcgacaccaagcccggcggcggcggcgccaacttcgcggcgcggctgcggggcatgcgcgcgcaccaggcgcggcagctgcgcatggggtcgctgcggcgtcacggccgcgcggcgcgtgtgtcgctgttgcgcagctaccgcaccggcgagctgcccgacacgctgtcgctaaggctgggcgagtccttcctgcggccgctggcggcgctggtggaggccgacgccaccgccgccacggcggcgctggcggcgctgacggcggccgtgctggaggagggcaacaccgccgccgggtcggaggcggcggcggaggcggcggcggacgtgcccgccgctggcgcggcggagccggctggatcaagcggcgcggcggcagctgcgggcggcgatgacggtagcctggtgatcctgcggcagcagcagccgcagcacgccagctccgcagagcagcgccgcgccgctgccgagcgcgagcgggccgagcggcggcgggcggcgcagcagcgggggctgcacgccgcgctggcggccggcttcggctgccggcccacggcgccggccttcgtagcggcactgcaggcagtagcagcgcgcttcgccgaggccgcgctacagccggcatcactcaacggaaccttcccgccgccggggcagcctgctactgccgggggcgcagacgctgcagcggactcggaagcagcggcggcgggggccgtagcagcgccgccgccgccgctgctgttgctacagccggccgacgtgctggcggcggcgggcgcctgcggcggccagcaggcggctgctctgcttctggagacgcagcaggcggcgctggaggagcgcggccgccgcctgcaagagcagcagcagcagcagcagaagaagcagcagcagcaggctgcagccgcgggcggccgcagcggcggcagtagcagcagccgcgccgccagggccgccgccaatgccgtgcaggctgtacagatcgggctgcatgacacactggaggcgctggctgtggcgtacggcgatctgggcgagtccgacgtggcggcggcggcgcgggcggggctgctgctgtgtcccgtgacggcggcggcgctggcggcggaggcggcggggcggccgcggctggcggtgcggcggctggggcaggcgcaggcggcggcggagatggtgcaggtgcgtgcgtgcaaggcgcagtcgcgtgatgtcaatgcgcgggggtcgctgcggcggacaagtcttcttacttcgactgctgttgcgctcactccaggtgtagggacgtcatgtgcaaaggcggttgcatcattgccgtgccgttttcctgaccctcatctcacataacaccatccaacgccccccgcatcgtaggagctgggccctgtcgcggcggcggggctgcccgtgcccgagcggccgcaggacttggcgccggccggcgccgtgactgctgcttcggcagatgccgccgccgccgccgccgccgcgggtggcactgtcggcgaggttactgtggcggacctccttggctctcaggccctggcggctgcagccaccactgcagcagcagcagcagcagcagcagtagctggcgctggcaatggcagtggcggtggcggcaaagatgtgggcggcacaagtggcggcggccgcacaggtggtggcggcggtcaggggttggcggcggcgccgccggccgagtcacggctgtggcggcaggtggtggtgcgatgcgcggacgcgctgggcgactggcagcgcgtggaggtgggatggaggtggggtggcggtgggagtggcggggtgagtgacatgggggcagggtcgtggaggggacatgggggcggggacatggggccagggggggcaggtaggacgctaggcggtggtccttatctggacggaccgtcacacggcccgtggacgatctttcccacctgtcctgatccggcaacccaacactgtgtttgcttccatgcgatgcgcacgccgccggggccgcagacggagctggaggcgcccgtgcaggagctgcttggggcagcgggggccgccggggccgctgccgggggcgtcggcgccgcttcctcatccacctcgggggcaggcctgttcacgggagctgacgcggcgccgccggacctgctggcagcagccctggtgcgcggcctggcccgcggcagtagcagcagcgcaggcggcggcgttaacggcaacggcagtagcggcggcgccgccggctcggcggagctgctgcggcgtgcgctgcgtgcggcgctgttccagcttcgtgagtccgacgtagcgccgtcgggccatgggctgggcgccatcatcggcggcggcggcggcggcggcggcggggatgtcatgatggcagatgctgctacagccagtgacggcggttcgcatgccgccatcgcggcctggattgaggcgctgttggagcggctggatggctcgcaggcggcggcggcggcagcagcggaggcggcggcgccgctggagctggtggcggcggcggtggtgcgtgcgtgccgccagggcagctgggagcgatgtctgggggaggtgcaggtgagcgtcattgccaggcctgtggtcatgcgcttgtgtgttggcgtgcgctccggcagtctcgcctgtcattaccctcgcatgactctcgccttgcgccgcgccccttcctgccctccggcgtgcactcccgcgcgctgactggcggcttgtgccgtgccacggtgatctgctcccccctcctctcctctccttcccaaccgttgcctgctctccttcatctgcccgcagtcggctctggcccggctgcgctcgcgctgggccggcctgcacccgttgtcagccgccgcccgcgtcgccgcgctgtcgctgctacagccactggcggagatcagcgaggccgtgcggcaggtgctacagccgaccgcggcggctgcggcggctgcctacggcttacccgctggttcgttgcggctaagtggcggcggcggcggcggcagtagcagggcagcagcggctgtagcacctgggcatgcgcgcggggcggcggggccgctggcggagctgaggggcttggtggcgcgctggcggcggcgtggcctggggctggcggtggcggcggacggcggcggcggcggcgcgggcgccactgcggccggcagcgacctcatgtccgtgctgcacgtacgtgaacgtgcacgtgcgcatatattagtagtggaagggggaggagaaaggatggctgagaggcaagtggttgggatattgtggcttgctggcgcggcacggccgcgtgtcctcagctttgcgtcatgttgctgtgcaactgcagcagcagcagcagcagcactaaccctgtgtgctactgccaatctctgtcctgtaggtgcgccgtttgctgctgctggccgctggcacccgccgccccgcgaccgcgacgccgtccggcgcggcgacagagcctgctgcagccgccgccgcccgggcactgcaggccgccgcccgcgccgccgccgccgccaccgtgtttgacgccgcggcggctgcgctgaggtccgggtgtgtggacacggcggccgaggccttgcccgacttcgccgtgggtgacgaggaggtggtcgaggtggtggagggagctacggccgcggcagagggcgcggacggggcagcggcggaacggcgggcgcgacagcgggcgcgggcgcggctgcggctgtttacggcgcacaccgacgcggctgtggcgcaggcggcggcggcggaggctgccggcagcggcggctggatcggcagtagcagcagcggcagtagcagcgatgttggcggcactggcggcctgtcgggttatgattggcgtgtgtatgagggactgaatgggctgctggcggcgctgaggccgtggctcaagggcgcgacggtggcggcgacggcggtgccggtgctgggtccggggcaggtggcggcagcggagctggcacagtcgcgggcgctgctggcgtgggcgggtgggtgctgcttcatgggtgtagtggttgtggttggtgtaggctgttgtctcatgtgggttcttgcctcgtcccaccgcccccgagccttgcccagccgagtccgattctgcgcactgacccgaatgccccctccccgccgcccttcccgggccgcccccgcccccgcagccaaccccgccgagccgcagtacctgaccgcccgtgtgggcgctgccctgttgagcggcgccacagcggccgcagccgccggcgccaacctgcagtcacagctgcagcggcggcggcagcagcagcagccgtccagcccagccccgcattcgcagcagccgctgcagttggtgctacagccgcacgctggcccccgcgagacggcagcggcgttgctggcggcgcgcgcctccgcccacttcgccttcatgtgcggccgcctgttgcgagcccacgacgccaccaccgccgccactgctactgccgctgcagctgacaatgctacagccgccaccggcagcggcagtagcaccggtgaccccggcatgccgccgctgaccgcgctgccggccaaggtgctggaccgcgcgctgcgtgccggcggcagtagcactggcaccagaggtgctgctgctactgccactgcggctgctgctgctactgccgcggcggctggcgagctggccggctgcctagtgaggcacctgctccgggcgatggccctggccggcagcgccccggtgacggcgggcggctgggtcctggggggtgaggggggcgagggcgaggctgtagcagccggcaggcacggcagtagcagcagccagcatgacggcgatggcggcggcgatggcgatggcgagggtggtggtgatggtgacgatgggtgcggcgggggcggtgtgccggaggtgcggctgcacgtgccggtggtgctgagtgtgctgcgagacggctggggcggcagtagcagcggcagcagcggcggcggcggcagtagcatctgcggtggtgtcgacacgacggcggcggcagcagccgcattccgtgagggctggtcggacgtgccgctgggctgcttcctgccgtgggcggggcagatgtgctccatgctggcggatctggattcagcgagtgcgggccggtcatctggatccggctccgacccgagtgcttcagatccagatccggatccagttttaggcccgctgactgcgctgtcgtacgcctaccctcagctgctgcacgcgccgctgcgcatgagcgcggcgggctttgcttcggccggcagcggcagtagcagtagcaatagcagtagcggcagtagcagcggcggcagggctgcggcagctgtagccccgctgctggctgccacggccagcccggtgctggagggcttcatcgacgccctggacgcagccacctacccggcacagaggtgggcgttgtggctgctgtgttgtgtcttgtgtgttatgcgatttgcggagatgggggggagatccctccgtccaggtccatctccaggacacgcaacagccgtgtggtagtggcggtgtcatggtgacgaagcctacgttaggacaggctgtatccgtaatagaaacacaccccacggagagggctcaacatgcaggggttggcgggtccgcatactcggcaggggctggctgccgttccacgtgggtttcgcaggtgctagctgggacagtagaacagtatccaacacactatccaacaggacccgaatcctcttgaggggcacagcgctgccgtgtagtagtggcggtgcatgcgcgtgcgagcggcgcattggcgaacggcacggtgtcagctgcgccggccgcctgtgcactcgcacttgtcctccaaacaaactcacaggcggcacggcacacacacagtcctatgcgtgtttgcttccctgaccgcctgctgtgtctccctctccaacatcacaggtggcaggtgtttgtgtcgcgcatccgcggcgccctgcagcgcggcgggctggacgcagccgtgcgcgtgtggacacacgaggcctggcccaacctcttcggccgcttcctgccacacggcgcagccgccgccgccacagccgccgccgctggcgcaccgcaccgcgcgcagcgcgccacccgccgcgtggcggcggacggcggcgccgccgccggcggcgccgccggcgccatggcggctggcgacaccgtcaatgcggccttcgccgcccgctaccgcgccgcgtttgaggctcagttgggcggcgccgacggcggcgagctggcggcgctggcggcggcgatgcggcgggagcacgcggcggcgcggcgggcggcggcggaggggcggctgagcccggaaggagcggcggcggcgggcggcggggcgcggacgcgggaggctcggctggcgggcatgtcggagcagcaggcggtgtgtgcggccttcgacggcgcggtgcggaagatcatgaccacatgcatgcagcgcgggggcggcggcggaggaggaggtgggggaggaagcagctcgtgggaggcgctgcaggcggcggggccgcagccgctgtcctggttcagcccctggttcggagcctaccagcgcgcggcggaggacgcggcgacccaggcggcggcggcggcagtgacacccggcggcggtggcggcaacaggtggggtctgcgcggtgtgaagtggcgggtgggtgcgtgactgcgtgtgcgtgtcccttgtctatccgccatgttgtgactccgcttccgaggtgttatgtacgcatgacactgacacgggtggagtctgtaccaatcaatatcgctgctcctcctcgtcctcctgctcctcctgctcctcctcctcctgctcccacccctcccctccaggctgctccaccgcacgcagctgctgctgcccaccatggccttccccaccgccgccgcgccgccgccaccgcacggcacgccgccaccgccaccgcatgcacgcacccaccgcccctcccaccacccccaccaccacccgccccttcctgcgctgggctgtgaggacgtggcgccggtgctggtcactggcttcggccgcgacgtcaacgtgttcggcagcaagcagcggcccaagcaaatgacaatgttctgcaggtggggcgtgtgtgggcgtgcgtgtgtgtgggcgcgtgtgtggggggcatgcgtgtgcgtgtgcgggtttgcggacggaggagccggcctgggccctatcgtccgcgctcccgcttgcctctcacaacccgaacggcaaccgccttgcctctcccactgcctctccctgtgcctcttcccctgcctccccgcccatctcccccctttcgctgggcttgggctcatgaccgcccctccccctccccgattgcctaccgtcttccatttccttagcttgtcatgaatgtaaccccgcccctcgcgcccccccccctcgcccctcgcacccctgcagcgacctgagccgccgcacctggctgtccaagggcggcgaggacgtgcgactggacgagcggctgcagcgcctgttcgacgtcatgaacggactgcagcgccagcagccgggtggggagggagcgggagggagggactgggaggggctgggggacggcgggagagagggagaggtgggggaggagctgcgatggaaggggaggggcgggcaggaggagcgcgaggaagagggaagaatgagcggatggggcggggggaggtagggtatggcgggtcacaaataccgtgaagtgggtcataggcgcggtccctcacgcgatgcacgacgttgcaatgcagcgagagccctcatctcccgcccaccccacacctcactgagctgctccccctccctgtgcctccccacccctccctgctccccgcccagcctgctaccggcggggcctgcgtgtgtcggtgtttgcggtggtgcctctgagcgcgagtgtgggtttgctggagttcgtgcccggcactcgcccgctgcaggtgcggtggcccactagccatgcgacagatgcgacctgagggcagggcaggagtcctatggggggcaatgggcgtggcggggcggggcggggcggggtccaccttggctaagcctgttagctggtcgacctgtgacctgccaaccaaccgcaaccacaaccgcccacccaaccactcatgtacgacacacacagagcgtgctgctgggcgggccgggcgcgccgcgggacccggacgccggcgcgcgtgtggctctggcgtgtttcgtgtgtccgcccgccggcgtcccccccgaggttggcggctggacccgcggctacgaggccatgtacggagccatggggccggggcagcgcgcggagccggcggcggcgcgggaggcgtttagaaaggtgcgcccatgccgcacctcctcgctgacctccgccgtcaatttcagctggggagcacgcctctctgtcggttggtccactcccccatgtcccccgcacacacacaggccgccggcgctctgcctccctgcctcctgcgctccgcgctgcttcgctcctgcggcggcggtcccgagctgttcctggcccggcggcggcgcctggcctccagcctggctgcgggcgccgccgccggctacctggcgggtgtgggcgaccgccacgccgacaacgtgctgctgcaggccgccaccggggagctggtgcacatcgacttcgggtacagcttcggcgcgggcacgcaggtggtgcccatccccgagctggtgcccttccgcctcacgccgcagctgcaggccgcgctggcgccggccgccgccgccgccgtgctggagccggcgctggcggcggcgctggcggcactcagcgggcccagcgcgcggcagctgctgggggcggtcatggaggtggggatgtgcgtgtattgtgtgtgtgtgtgtgtgtgttcagttgtgtgtgtgttcagttgtgcgcgttgaagtccgctggcttcaaactgcattattgggtatctaacaggacgagggaaacgctccgtgggtgcggtactccgtaggtagtcgccactgccctgactcgtgtgctgcatttgcctcctgctgcattcaaagccctgcccacatccccaccccctggcatcgcatgctccaggtgttcctgcgtgagccagtggcggagtggcagcacgaggcggcgatcctgcgcagtctgcaggagtcagcggcggcggcgcaggcggcggcggcggcgcggcagcggcgcaaggggcaggagcggcaggagggcgcggaagcggaggtggaggacagcagcagtggcagtagcagtggcagtagcggaggtctggtgctcacggacgatgcgggaaccaacagcagcgaagcgccggcggcggagctggcccgggcaagggtgagtaccgtagtgctgagtctagaggaaacgcgcccaccccacacgtctggggtgcattacttcctcggtagttctcggggtatatgagtgctgatcgctcctcaacactttcaagttccaactttctctcgccttgtccttgttttcgtcccacacactgacacgcacatgcacccgcactcgcgcgcaggtgtccacggcgctccagaagctggcccggcgccacccctcgctcatcaccgcggacgagctgcggcccgtgcacggcgcccggccctactacgcagccctgtgcgccgcggtggcggggggggcggcggcggaccaggcaggcggcggcgggggcggcagcgtgcgcgcgcggctgctgcagcaggtgcgcgtgtgtgcgcccggggcctggggcctgggcacaggggactggggcctggggtccgctcggccacgccgcctgtgagtcagtaacgcttccccctttcaccccaaaaaagacacacagctccgcaccgttgccttaccgctcacgcacctgccccaccgccgcacgcaaccccctgcacacacccgtgaacaggggcccctgctgggtgcgggtggcgcggggggtccgctgctgctgagcccgctgctgcaggcgcgctgcctgctggaggcggccaccgaccccaacctgctggcgcggacctacctggggtggaagccctacctgtag

SEQ ID NO: 6 - DNA, 4481 bp, Chlamydomonas reinhardtii
atgcgagctcttggctctggcgtaccgcgggtggctcgggccggtgtggccaggggcccggcaccgctgaattccttttggcgttcttacggctggggcgctgaaaagacgaaggaatctcagtttacttttgacgtgagtgtgtaaataattcgactacgaaaggaacgacagtcggtctgcaggccgcacgtcccacagctcaggtcactgcccacgtcgcttgtgcccgtccttgccacccaagtctcccgtgctccaacccgcaaacccgccttcctttccaggaccaccaagcgatcttcgagggccgcaccacgccggacctgctcaagtcgctgctcgtgctgcggctgtgctccacgccctccttcgtggcctcggcggagggcctgctcgccaatgcccggcgtgtgatgggcgacagcaccgccctcagcttcgtgcgcaccaccttttaccagcatttcgtggccggcaaggactcgggcgacgtatggggccgcatgaacacgctgcgtgcgaacggcgtgggcgctatcctggtgagaggatggcaagcgggcacgcaagtggggtggtgccaccagcccgatcagggctggaaccactggagggagcggaccaaagcggtggaggctgcgagatggctgggttacaggggcgccagaggcctgcagtatgcggagctggcgcgaagctgggcgatcgcccttccaactttggtgctgttctccaccgattgcgcccgacacaggactatgccgaagaggaggacctgctcaccgcctgcaagcagcccgcgccgcccgccaccaaggcgtcggctggcgcggctgcgggcggcgcggcgcaggtgtctgcccgcgaccccctgggcggcgagtcgctgattgagtcgggtgtggcagcgaggacgtacacgttccaggtgcgtgcgggcatgcagtccactgcaagtgtgtgctatgcatatggcatctctcacggaaggtcatcaggaaggcgggacgggagctgtgcgcggggctacgtgcgccgtggctaagcccaagagctctgcatcacacacaagaaccccgctgacctgccgtcctcccgccccgatgcatgcaaacacgcaggacgacgccacgtgcgagttgcgcacacaggccttcctggcggccattgacaccgccgccacactgcccggccagggcttcgcggccatcaagctcacagccctgggggaccccgcgctgctggtgcgtgcgtgcctgcgtgctcctgtgtgctgctcctgcgtgcgctcatggcgcccgctcacgcgctgcacatgttttctgcgcccgacagcccatacggtatgcgtgtccttcaccgactcacgtaaccgccgcccaaggctggtgccgtgccatgctccctgccgtaccaccgtcactgaagtggttacggtgctgtgctgccgtacgtctgcactgccgtacgtactgcaggagctcctggcctcggctctggacgcagtgaaggccctgtttcggcgctatgacagcaacggtgacggctttgtcacgcggcagggcttcctggaggccttcgagcgcatcgagaaggcgcagggtgagggcccgctcgcttgcgtgcgcccggctcgcagcacctccgctgtttgtgcggctcggatactagtgagctgatcagacgctgccggcattcctctcggctagccatagccttgcgctagctattctgtacccaaacgtacgtgtgtgtgtgtgtgtgtgtgtgtgtgtgtgtgtgtgtgtgtgtgtgtgtgtgtgtgtgtgtgcacaggccgcagcagcacaggggcggagcgcaacgagatgtgggcatggctggacccggccggcgacggccgcgtcgactacgtgacctgggccagccgcctggacctacgccgcctgcctgacatggccgccagccttaggcaggagctggagtcgcagaccggtgggtgacggcgcgagtgacgtgggtggcgggcagaagggaggagtggcgggaggtctgggcgcagggtggcgctccgcgtgcgtacgtgagtagggtaatgtgacccagaaccgcgccgcactgacacccttcgtatgattcctcaacttttcaacgtatctgctgtagacgcccgtggacggcagtgggagatgtcggctgaggagctgcggcagctcgaggcgctgtttgggcggctgcagcggctggtggcgcaggccgtcaagaaggtgggccggaggcaggggaacagggcggcactgggtttggtggaactgggttgggtgctcgatgccagtgcgggacgggctgcacagccacgagggtatgctcggtgtgctaggacaagcgccctgagcgctgagggtagccagacgtttgggaggcgggcggaggacgcaaggtgtggcgccgtgacgcatcaaaaccagccaaagccgaaacggcagtaccgtgtgcttctgcacaaacagggcgtcaagctgatgattgacgcggagcagagccacctgcgccccgccatcgaccacatcggccgcgagctgatgcgcgagcacaacaagcccgtcagtgcgggcggcgagggcgccgtcatcttcatgagctaccaatcctacctgcgcgacgtggagctgcgcctgcagcgagacctggagcgggcggagcggcagggatacgtgctgggggccaagctggtgcgtgatgaagcgcgtgatgtcggcggtagtgctggtggtagagacatgtgcgcctgtgcacgtggcgatgaccggcgatgtctatgcccagctgctttcaccctgagggacccacctctcaccatacgtgcgctcatcatcaacgccacgccccctcgccatcatgccttgcacccactccttgcgcccactccttgcgcccactccttgcacccactccttgcgcccattcgtccttgcgcccactcctcattgcgccctgctgcctcccgcctcaggtgcggggcgcctacctgcacctggagcgccgccgcgcagcccaggccggcaccgcctcgcctgtgtgggaccacatgagggagaccaccgccgccttcgacggctgcctggacacgctgctgcgcggggtgcaggcggggcgggcggagctgatggtgggcacgcacaaccgcagcagcgtggagggcgtcatcgagcgcatgaacaagctgggcctggagccggaggaggcgcatgtgtacttcggccaggtcagtcacatgtcgggcatatggcgtgaggcataaggcctgtggagacgtggagtggggtttggttatggcgcggtctgcagcggagggcatctggccgtgtcatctaccttggggaactgcccgtctaacattgcacacactgcctcacgtacacatttcccgccccacgtttctatctccacactgcccaccactgcattacccttcctccatctccaccacccctcaccaccaccacccctcaccacccctcaccaccccctcaccaccaccaccaccaccgccttccacgcagctcctgggcatggccgacaacatcagcttcacgctgggacagcacggctacaagtgagtcgcctactgatgaggcagcaggatgggtcgtgggggcgggcatgagcagggaaggcctgatatcctgcccgcccgaggcaaatatgcgcatcaacccctgtcggtaacttcctcctagatacaggtcccgcgtggccaaccgtgagcttcacctagataacgctccctgtgaccattgttcatcgcccgtgcgtgcagggtgttcaagtactgcccctatggccaggtggacaaggtgcgtgcatgtgggcgtgatggacattaggaggcgcatgtgtgcgcgggcgtgtgggcgccatgtccagtcgtaattccaccacggccagtcccatcagcaccggagctagctcttacttatcctgcttgtggtcgcacgccttctgcacggctgtccatttatggcttgtgccgcttgctgccagtactgcctgcgggcgcgtgtctcccaactccctcgctcgcgcctaccgcccgggcactgggctccgcaggtgatcccctacctcatgcgtcgcattaacgaggcgcagtacacacgcaaggtgcgtaagggtgcgcgcgcgtgtgcggctagtgcggctttacatctgcgctcgaccgccgagtgtgggccacgcttgctagggggttgctcgcagtaattggcgtgtcgtcagcagccctcggaccacacgttcaacaccaccctatttaacccataacgtttccaatagtgtttcatcctgatcatgtaccgtactcgctcctcgcgttgcggccctcgtcgttgcagggcggcaaggaggacgcggcgctgcttctggaggagctgatgcggcggctgcgcgacccggcgcactcgcccatcgcgcgcatcttcagcaccgcctcctcctaa

SEQ ID NO: 7 - DNA, 5911 bp, Chlamydomonas reinhardtii
atggactatccaccgctgcaacaggcgcctggatttgacctggccacggatgacagcgggcgagaccccaacatccctggctccttcgccgcagtggtcgtcaagcggtctgccaacctgcaaggtaagtgtgcgtgcatgcaatcatgcatgcgcccaccaccacttggcagcgccgtacccacatcttacagcttgattgatcctcacacctgcgtgtctacgtgcgcgtggatggtgaggatcctgcacacgtgaggacagcatgcagcggcacacacgtacgggagctcacgcgtgtgctcccgtagacagcgcgttgcgcgcattgcatttataccgaatgctggtttgccgtacgctgctgctggtgcgtgtgcatgtctgctgcccatgttatgcagaggtctgcttgccgccggcctacgtgcccaatgcgaccctgggcacctggactcggcccacggagctgccggcagggaagcagatcacctactcgaccaacaccacgatcgtgttgctgcaccccaactgcactggtattggttttgacatgccgtacgaggagcagtgcatcaaatcttcgggaggcacgtttgtggatgtgggcgtgtactgctactcattggacccttttggaaaccaggttaaaaccggctacgtgtcgcacctgctggatagcgtgaaccgggtgggttatgctgtgacagttatcgcactttgctgcttgcttggttgcatctggcaaccaacactactcgttccatgcgcatagggacgaacatgtgtgtgtgtgtgtgtgtgtgtgtgtgtgtgtgtgtgtgtgtcgggggggtgggtgcgtggctcgggttttggctggcagtggatgcaggcgcagcattctgtgcggtaggaagggcaggtgacggagcaacaggccgcgcatcgctcgctcgctcggtcgcgtgcatggcatgcacgcatggcatacatgcatcaaggggcagcagcgggcacgccacactgcatataacgggggacaggggaccccgcccacacaccctacacccctacccgcccctcagagacgccccgcccgtctccgcatttgttcgcgtcgcactttcatgcacgtgcgcaatcacgtgtacatgtgtgcatgcctgcagtgctaccagtacatgaccgtgggctgcattgatacgtacggcggtgtactcggctgctacaatttcatgatgcaacaggtcggttgtttggttcattcgtttctcattagtgatatggtacatactagctagtagcatgttgcggctcgcgggttggatctgtgcatgttgctaacggtcggttgcattcgccgaagtgccaattactcaatggctgacccggatgggccgggcctcccttgctcgtcctctcgtgcgtgcagcgccaaaacaataacagcagcagctcgccgcgccaggcagtgccgccaccaccgctggctcctgcaatgaccggcgtgggcgggcgcagcaaccagcaagcagccctcatcggcgctattgtgggcggcgtggtgggaggtgcgtggatggacgggaatcatggggtgggtacgtgtcgtgcgtgcgtttctgttcgttgcggggccatgtacaagcaccctgacttcgtacatgtttactataaagacagctgaaagggctgcaggttgtatgtatgtgtgcttgatgcgcgttgccgcacgcgcttcacccactcacaggcatcgtgctcgtggccggcgtcgcgtgggccaccctgctgctggtgcgccgccgccgttatgcggaggcgccggcggcggcagcgtctggcagccggcacaagagcagtgacgacggcgagagcgggggcagcagtagcagctgtagcggcaagagcggcggcggcagtgaccctgttgaagctgcagcgaagccttgcaacccaacgtacgcctttagcggtggcagcggccctgagcacgccgccgccttgccgacagcagtggctagccatttacccactcagcagcagggcaaggaggaaaaggaggaggaagcggtggcggccagccatttacccgctcagcagcacggcaaggaagatgaggaggcggtggcggcggcagcagcggtggcggcggcggcggtagcggcggcgcctctttttgctgatgagccggcctcgctcgtgcctgtgacgcccttgacccctctgcagccccacatccctctcggtgtcacggtctgtgagggcggcagcaccctcgctgcagcaagcaggagcaacagcaacagcatcagtcttggcatccatggtgacagtaagagggcccccgtaagtggcggcggaccaagtggcggggctctcggcggctgcggcaccagcggcagtactgatgctgacagccgcgcactcgtgttcaagggtggcgaaatagcagcagcagcagtagtcggcgggagctcggtagtgccagcggcggcggcggccggtgtgacgaccagcagcggcggcggcggtggtcaaagcggcgacgcggccccaccagcaccgagctcagatgctgcgacacgtgctagcggcggcggcggcggcggtgcgccagcacatgtggtgctgaccggcgtcgtgatgggcaaaggctcatttggcagggtaagtgtgtttgtgtgtgtgtgtgtgtgtacgtgtgtgcagaagcacgtgtgtggcagcgagagtatataggtaaaggtaggtgtgtgggcggcggggaggcaggtacgggagggaggtaggggagggaggtaggggaggaaggtgggggagggaggtaggggagggaggggagggaggtaggggaggtaggtaggtaggggaggtagggcaggtaggtagggcaggtagtaggggaggggaggtgggtagacggcatgtggctgcttcagcgcgactgctcaaccgcccagcgtgctgcttgtgcgccggcggtcaggaggggggggggttgcttgtagatacggcggtactagcccaaactaaaccgaacccaatgcaaaagaagaggggcggagggaaatggaagtctgggatggagacacacaagttacacaagtgagggtgggctgcatggctgtgcctgctgtcccgacgtgtcacccctgcctgccgctgtcctgtcttggctcctcgctcctcccgttagtgtcctcctcgctcacccctggctcacccaccgattctatctgtcgttgcaggtggttgagggtgtgtactgcggcaggcgggtagccgtgaagcagatttacacgggtatcctcatgcaacaggggacacagcagctacggcagcagctgctgacacagcagcagtcgcagcaggcacagcaggcacagcaggcgcaggaggcgcgggaggcgcagcagcagcatcttcaggatgtgcaggacagccttatcgcggcgttggagcaggaggtgcaggtgctggccaggtgcgtgcacggacggcacgggggcgggctagataagagttcgaggcaggcaggcatggcaggcaggcaggcacgcgcttgcgcagcacgcactcagcatgtgtaaccctgtttccgaattggattttccagatgtgcgaagccgtaaaccgcatgttaagcccctcccttacttgctcgtgtacttcagtttcctgcgaaagggcaggcacagtgaaactgtgaaagggggtgcccttgcgaaggcatgcgtaaactgcgctcgtaacccttgctggtgtacttttctttcccactccgcacccctcgtctgatgacacgtgcgctcacccccggtgccttttgcctgctgcacgtgtcaacagggtgcagcacgagaacatcgtgaccctgttggccgcaaacctcgagtgcgtgcatgcgtgggggccggggaacggggaaagagccgacactgtacttgcttatgtgtgcgcgcggcggctgctcggcttgctttgcggcttacatgcgtgctcgcagtaatgacacgcaaccacacgcccaagccggcctcgccaatcttgacatacccattgctcgttcgctcgctccgcgccctgccgcccgcgcgcgctccctgctgcctcgctcacaggccgccgaacgtgtgcctggtgatggagcggatggacacgtcactggaccacctgctatacaaggaccccaacagacccttccccctgtcgctggtgagcgtgcgtgcacacacacacacacacacacacgcacacgcatgacggcagcggcggagcatgcatgtttgcgtgtgtggtagtgtctgtgcctccagccttaccttgcgtctccccatccaagcaagttcatgacagcatgctccatccctgcctggctgctccgccggccccccggccgctttcctcaagcaacccgccgccttcctcatcttcccccttctccccctgctgccatgcactgtcttgccttgccttgccttgccttgccttgcgtgtgcgtgcgtgcgtgcaggcagtgcacatcgcgctgcaggtggcacgtgccctggcgtacctgcaccccaccatcctccatcgagacctgaagccggggaacgtgctcatctccaacgcggatgacacggcggctgcggccgacccgcacaaccaccagcacgttgttgtcaaactggcggtgagtgcgtgcacaagcgagtccaagtgcgtgcgcatgcggtgcatggggccctgtgcgtaagagagagagtgtgtgagtgtgttgggaattcacacctagcatgagaccgatgtacacagggcttgcccgacaccttgttcgctcgcagcacaaattaactgtgtgccgcccttggtgccgccgcatgctttgactcattgaaggacttcggcctgtcgcggctgcttgaaacggtccttgtcacgcaagagcccgaagtcggcacggtgtgtggggttgggtgggtgggcgggcgggggcctgatgccgcacggctgcgatcaacacgctgagccacttgctttaacacagcagcactacgtgcgttctagccgtgatgtctcatcacctacctgccctgctgcgcaccgccgtggtagggctggcgggccttgtagatccaccgccgcgtatggtgcaatgcgatgtgcaagctcctgctgctgttgttacttacagtccttactttgttacgtgcgtgctctcatcatcaggcaccctacatggcgccggagtgctttgacctccagaacattgtcatcacagaccgtgcggtgcgtgcctgcctgcatcatttcgtgcatgtgcatgggtggcatgtctgtgctgtggtgggggcatacgtgagcatgcgggcgatgcggtgtgccggaaggcggggatccgtggacggcggcagccaagggccgtcctcaagccatgcagcagtgcttgcgtgagtgcgtgtgctacccagccgtgccgggtcggtgcgtgccgcccagaaaagccgaagggccggttgctgtggcggcagcgagggccgcgcacgcgctcaagcaggtcatgcgtgcgtggccgctaaactcatgcacgcattggccgcccattcaccaagccagtcacgcacgtgttactcacttgcacccatgtgtctgcccgctcgctcgccatcaggactgctactcgtttggagtgctgctgtgggagctggttgcgcggcggcagccctggtcgaaacaaaatatgatgcaggtggcggtggcggtggcggtgaacaacgaccgactgcccctgctgcccctcgttgaggccggtgcgccgcccaagctgcagcggcttgtgacacagtgcttcgacgccgatccgcagaggcggccggcggcggctgagctggtgaaggagctgctgctggtgcagcagcagttggcttctgggtcgactgcataa

SEQ ID NO: 8 - DNA, 6155 bp, Chlamydomonas reinhardtii
atgttcggggaccccagctcagcatgcagtaccgatgttacaaacacgtggacagggaccgtgtgtaacggcacagtgagttggaatcccgacccagcagtgaccgcctcttggcgaactggcgcctaagggctgctgatcgaacggtagtaatacgcatcatgttgtgagggtgggagaatcggttgtaaattatggtaacagtgcgaacatgcatgtagatatttgtgcagccctgggcgaacgtgcttgtgcaccgtcgaaattcacgcgtctgcgtcagccttcggccgggatcgcacattgggcgtggcttagcgcaacgtgtcgttgttaaactgcactcccaaccacgtgacaggcatggtacggcgtgggctgcacgggagacggatcggccgtgattaacaacacgggtgaggcgcctgcaagtgctgtcgggtgtggccgggctggttgcatgagtgaggatgaacatcgaaagccccgcacacgcctccaggggccttccctgcctcgcttggtccagggcgggtccgggcaggtccggttggttgcccaagggcgcatccccctaccttgctagtgtgaccggcgaaagctccacggctcttgggtcccgacgccgtactgctcggactccacacaacttgtgtgtgcctttcccatgaccatgacctgtgcgctcactcacatctattcacccttgtgtgcaacaggcttcgtggagtcgctactgctgccgaactgcttccctggaggagtcggggtcgcggcgtcgctgccatctcaggtctcggtcctgacggctctgacgcggctggacctcacgggcaacaagttggtaagaagttagtccagagaaggggagccgagataccgtacccaacaatggtgttgatgcatgtatgctctgggacagaggttgagtcacgtaggcacgtgtactgacacggcccatgtgcgttgtgtgggtgagggcaggtggtatgtgtcattccatccagcagccttatgcatgggctatgagtgtttctttcgtggctagcggtgggcctacgtctgccctcttacatacccgaccgcagagccccaacagcggcctaccagcggactactctgccctgaccggtctgcgcctagtgggcctggcgtccatggatctggaggcgggcccggtgccctccagcgggttcccacaagagtggtcctcgcttgtcaacctgcagcagctcgacctgtccaacaaccggtgcgatgaggttatggagacgcgatgggggctgggggatgtaagagagcaacaacgcttacatgtgggggcgtgctcacacgacggtgtgtgcgagggtagggctgtacggatacgggaggctttgcagagagcctcacgtatggcaggctgcccacaacacgccccctctcgtatccattcacaggtatcttggtggcgagttgccgcaatcgtggacgaacatggcagcaatcgtcagcatagacgtgtcgaacacgggggcttgcggcacaatcccgggcggcctgagcagccaggtgacgccctcaggcctaccttcgtcctgtggtaagcgatcgaggcccaatacgataatctgctgcacatggtcatcgaatgggcgattgggccggagctgctttgatgtataactgcaagggcgggcaaagtgctgtaggttgtgaaggtgtctcggcgtcagagctgaatccaggccgcggcttccgcactctgtcgcgtgtgctttgcgctgacttacgctccctccacgcggtgccccacatccatatgctgaaccacagagctggtgaactgtcggcgctacttagtggaaacgctgcagcccatgatcgacagccaggttcagcccggctcggcctgcaacctcaccagcgcgtggcccagcagcttgagcattgactcgtgggccggcattacggcaatgattacggtcgttggtacaacgcccgtttctgacgtcatcggtttcgtgctgaacggttgctgtgagtctgaaccttgcatgcatggcagcacgggcatgtgggcgggatgcaacgcggccctgcgccctagtagtgtaccacgggcgctggagaacacgcgacagtgggcccgctaaagtgtccctgtgtcgcaaagcataccatccggtcgccacttttgacacttgctgctcactcgcaatgctggtgacacagatgcgagcaacggcaactccttcaacgtggtgttgccggacggcttgtcatgcttcggcagcctcacgcagctgctgttcaatggcaacaatgcagcaggtgggcaggggggcacagacgggtggttcccttgcgagtcgcttgcgagagaatgtgcgaaatcacaccagacacatgggggcggcagtgatcacgtcgggaaggtgggggaacggtgctgtttgccgcggcgtcgcccgcctcggtgcaacctgccggtgcgtgcctccatgccgccgcgcaggccccctgccggacgcgtggacccagctaaatcagctgcaggagctttgggtgaccgacaacatcctgaccggcagcctgccggcatcctactccgcgctcacggggctcacgacattgaagcttcacgtaagtgctccggttgtattgtcacgggagcgagggggccacgcccggggctgttgtaatgcaccagtacgtcgccttggctgaccagcccttccttcccttttgtacggcgcacacagcaaaaccagtttaccaacacgctaccgcctgagtggcaggccatgagcctgctcgcagacatcagcatcagcgacaacacccaactgagcgggtgagagcagaggtacactcccccaggttacctggctgagagcgagctaacagtcgagtgcgtgaaaacacagcacacgctcacgccctcctgctggcctaccataacgcatgtgcctgcgcactcatcctcgcagggccgtgccttctgcatggggcaacctcaccagcctcaccaccttcagggcgcggaccgtgggggttggtggccagctgccgccctcattcagcgccctgtcgcttctgacggagctcacgttcgtgtcggacaccctgagcggctcgctgccgagtgagttcactatgcgcagggtgggctttgatgggaggtggcctcacttggctcccggtgccgtctgccgctgtcgttagcatcatccgctgcttgacgtgtgggatatgaccccaacgctgcaggcgagtggagcacactgtccttgctccagcagctgaccatcacttccaaccgagccacgtccacgatgacgggcacgattcccaacgcttggtttgggcccggtggcattaccccttccatgtcgtcgcttcaggtgcggaaggcgcgcggcgtgggttgcgggtgcttccgtctcttgtcaaacatgaaagtggcatccgtgacaagtgacgcgctgctgttgctccgcgcgatgcaggccatcacgatcagcaacaccgcaatttcggggcccctccccaccgacatgtcgcaaattttcagcctcacaaagtaagtaggcgccgccttctccgcacgccttggtaccctccccacgcaacactatgccccgtgtagtacctgacactacatgttcactcgccatgatgacgcccttgcgcttccgcgctcaatccacgctcactccctataatggacacactgtggtatcatctctatttgcagactagacttctccgccaacaagctcaccggcggcccgacaccgtcgtctggatttctgttcgagtacaatacgctgcaaaacctgcagttgattagtcttgccagcaaccaatacctgggcggaaccgtgccatcggcctgggcagttacgatgtccagccttacatttcttgacctccaggacacgggagtgtgcgcgcccttcccgacgggtaggaggttggcgggtatggaggcgggctgcagaggttccatgggcgtgaaggagagccaggggtgacagcgggtttgtggaaactgtggcaagtgaggaaaggggaagcatgctaggaaacattgcaagcgtgcaatcattcaaggctgtctgcacgccctcatccgcctttgcaggtttgaacagcgcattaacacccggcacgtttgtcaactcgtattgcggtaagtgcatgtcagccgctagtatggatggccgggttggcaatagtgctgctttgcgtcgctgtgatcagtatgacggcgcccattacggtccaaccagccaagcaaccagctgctctgaacgcgcccaatcgcctcatatggcccgatcgatccctgtgcgtgtgtgcgccctcatgcgtgcaacctacagacgatctgcccgctgccctcaacctggccacaaactttaagccgcttttcgacagcggcaacgtcagcttggcgtgcgacttgagctcgtgggacatttcaaacccgttgtgcagcaacacgtggagcggcgcgctgtgctcagtcagcccaccagacagctccggcttcagcattgggcaactcacttcactgcaggtaggcctacccgacattgtgttcaggctccgcctgtcggctacccaggtttcaatctattatcccgcctcacactgcgcactcgctgcggtcaaccccacttgacaaggtgcagccatgcatcatcgtgcgtgtctacatgcggttgacgcccttgcctcggtcccgcccttcgcagctcattggctgcagcgcgccagctgctggcagcgcggctgccaggcagctgcccgcaagcattactcagcttcgcggcagccttcaggatctcgtcatctcgacgtcgtaccttactggcaccctccctttcggcaagtgctcgttggttgggagttgccaagctgctgcggcaggcgcactggctgtaggtgcacgagacggcctcagttcgcgagctaccagcagtaatatgccatgccgctccccggctgctgccccttgtaaatgttgcgcagaacttggcttcatgaaccagctcacgcgcatggacctgtcctgtgagtaaagggtaggggaggcgggcactgcagactggatgggctgccggacaggcgctccgagtcagaagcaggggccgggatgccatctgccccctgttgacgcgccccgcctccccggctcaccctcggtagggaacctggtcagcgggaccctgccatcattgtggagcggtctgggggctatgcagcaactggacttgagcgccaacagaaacatcaatggctccattccttccgactggagtggtaagttaatgccacatcggaatcagttcaaacgcacacccgtgtctatgacagcagtccctgtgtccgggcgccacaagtccgtgcgcttgtgcggcttaaccggcggcgtatcaagtcatctggcgtgtggccgcgctccctcaggcatgaactccttgcgcacgctgaacctcggcggcatggacaagctcacaggtacgtgcgtcgtgcgccgtacacgacccgaagtagcatgtatacgtgcagccatgctaaacacaccaacaaggtgaatccaaactgaaattgacatgttgcggtgtacccaagggtgtactcaacttgcattccccaccaatgcatccttacttgccgacagggccgcttccggaaacgctgatctccatcccgggcctcgctgatgtgacgattgagagtaactcccttacgggcacgttgcctgctgtatgggataacctgtttgcactcacaagtcttgtgattggtgcgggcggcaactcggcacccgggccaagtgtcaacggcacctttccgcagaactggttcaccagcggcaacctgaacaacctctgggtgagcacgggcgggggaccgggcggtgtaggcatcaaaactcttgggagagcattggtgtctaaaccctgcacattgtttccttgccctggtaaatcatgctacttgttgcgcagaacctgcgcatagcgaacacgaaggtgtccgggccgctgccggatcctggcagtaccttccaagccggctttatgggtctgacttctctggacctcagttccaacatgctcagtggaaccctgcccgactcgtaccagggcttctcgtaa

SEQ ID NO: 9 - DNA, 2181 bp, Chlamydomonas reinhardtii
atgcaggaggtactagctgcagcgcgagcatcgaagcaggtggcggagtacgcggaagcatcgcgtgtgagggtggttgatggctggggcgacggcctgcctgcggccatggcggctgcggttcaggcccgcggtggcggcctggtccgactgagagtgcgtcaggaccacgaggtgggtggtgtggattgcatgcgggggctgcgagcaggggagagcacgtcagagagctgtcgctggggggctgggggcctggctggtggggggagggcacagctgattgaggtcgagtgggagtggggatatgatgtacgcgtggggttgtgaggccaacgaccttcctagggctgggtgctgttattgaggccactctcctgggtgtgacgatatgctgtttttcatgacaggtggtgcagcgccagcgccgcagctggcgcgctcgagcggcacttgtggaagcgctggggattgagcggtatgacaacccaagctcagcggccaagctggtcctgctccaggcgaaacctggtgctgtgcttgcggacgtgtcgccgggggagcacatgtgcatggtgctgagcgcgctgctggggctactggcgtgcccagacctggaggatcaggtgtacaacgaaatcgcagtgagtggcgggcaggggcctgggcaatacagtacggtgggcgtcgaactgtatggtgatgcccgtgaagtggtggggaagacgggtcatgactgcgaccaaacaaggagtgacgctgacaccttgtccggggtcggggaagcgaggtgccgaggtttcggtcttgaatggctgcggtccttcgatcgctcggtgcacctccggtttggtttgcagagtgtactgagtgttagtgaaagacatatgaaccgaaaataccttgttagaggcctacttggcgaacatctcgtcgcagacagcgtttcaaccatattgtcgccagctaggttacaccattggaaactagagtgcgtgtccaggcctttaaaatacgacattgtgataagggagggtcgcggcacccgccctcgggaaatgtcaaggcaggtcaggcttccagcaccagagtccctgtatgtcaatggatggataaaaatggggtatgtaggggtatgcaaattgtgccggagctcaccggttttggactcgtgcggagcctcgaatacccgcctcgcgaacctgctcccagtcgtgtttatgcgggcccccgagtacagatttgctggcttggtgacggtgcgatggcccacggttcatgactggggacgttgacgggctctgaatgtgtggtttgcccgcagggtctgcttgcgggcgtggagctggaccacggacgggcactgcgtcagcgcattggcgggaagctgcgtgaggcggtcgaggtgctggaggaatacgtggctcacctccggtcaatctcggacagcgcgcagctcccaaaagctgagcatgagctgcggcgggcacaggaagcgctggagatgttggcggcacccgccgacacagacgacagcatgctggaggtggacaccgttaaggtggtcgtggacatcatgactgggctggacgttaacgtcctcgtagtaagcctggtcgaccagcaggacctgggcgggcacgtcactgcagcgtacagccggaccacgcatgtggcgctgcgcgagctggcggtctcgggcggtggcgccctggagctgccctcatgcagcactgtagtgctgttttttgcgcacaatcatgcaaactccgttctgctgggcaaggtgggcgaccagaagacggaggtggaggtgctgctggacatggccgcggagacgcacgaatggaggcagggcggcgttgtgtcactcggcagcggtaggtggggggtcagggaatgggttgcatgggagcacatgggcatgatggtcgtgcttctgtggagaggcaatggcagggagctatgttgttgatggatgccgtgtgtacaaatgcggcaggtggcgcaattggagcagcggcagtacagcgcgggtctgcggctggctcgtttgtgcagccgcagtctgctgaggttttgcacaggttcgtgccaacttttgttccttgcgcttctgtcctgcagcgcgcggcacaatgggtgcagctcaacgaggcgtgcgtaggtataccccagacttag

SEQ ID NO: 10 - DNA, 9535 bp, Chlamydomonas reinhardtii
atggtaagtaaggacttctgctccgagctgcatttgtccctgctgtacctgctccgagctgcatttgtcccacacacacgtgttaagggtgggctgtctcctgcgtgcgtgcctgtctagtatagtacatactaaacatatcatttgcccccttcacggccgcgcgcggccatttgatgctgactattatttcgatacgccgcttgcttgtgtagatattgttgactactacaccagcttcgagccgctacccatcaatgccaccatgtatgattggtacggccaggcctgcaagggctacgccacccagccccccgtgcaagtccggctgggcggcctgcgcaccgaggctgacggcacgctggtaagcagtttaaatggcagacatgctgctgatgcgcgccccgcggccggaggtcgatgctgtgcgtgcattagtgtatctatttcccagcagacaatgtgcgtggtcccagactcccccctcattcatcacggaccgcaggtgaacctggaggcaccggagaacatgaacaagtccggcctcacagtaagcactctttgtgctcatctcctacccgttgctgcatacagacatactgactgctgactgactttcgccgagtgcagcagtctaaacccgcgctgcccccccgtacaagacttccgaccagcagccaagacacttatgaactgcttctgctgcctcttacaattaatactatctactgccatggtggcgtaatgtgcagattgcgggtcgcacagtgacgatgtcggacaacggcctggcagtgttccagaacacacgccttcgtgcgcccgagggcccgcgcgtgctggagctgaacgccacgctgacgaagcccgtgcgcgagctggccagcgtcaaggtggggcgggcgccatatgacataacatactgagcttggtgcaagtagtcagcactgccccatccttggctggtgactgggcccacatccgtagaaaggacggtgtcaaggcgggagtgatgagccctcgtttatggagaggtgccacgcacctaattcgacgtcccctcagctgttcggttaattaggtccacgcgggttatgttagacaatggaagagcactacgcagggatgaaggttggtggtgagagtggcggggtggggtgggtcggggcgcgcggcggcacagtcatcaaatgcggatacttagctgtacgatgtgtacacatcggacatgtttacatgtttaaaggaagaccccccgtttcttcaggtttagcttggtgtgattttgatgacatacataataggggcccttgggtaggggccttgcttgatggcggcacaacccgcaatgaaacacctgcaggtgctggtgtacgtgcggccctgcaccattggcgagttcctggaccccaccacaaaggacatgtgcattggctgcccgctgggcacctacaacatgatgccagccgcgacccagtgcgagacctggtgagcgtgcgttcctgcctgcctgcctgcctgcctgctctgctgcctgcttccttggctgctgtgcttgtgcactgcgggcatcttccagcgcgcaatggcatgcagcggcacgcaaaacatacagtagtgcagctgtccatattgagcgctagttgcatggcgtgatcctttgctttgcttcataccgcagcccggacagcaccaactgcacggcccctgatgagggcgccatgatgctgcccgatgacggctactggcagagcaacctgtactcggagcaggtaggctcatgtgtcgctagctcagcagggtggagtctggggtgagggagccaggcaggaacatattcggcggggaaataaaacgtggtggtccgaatccggtagtatatataatcggaatcccatccggaagctgttgggaaagagttgttggggcgccgggatgtgcagggagagcacgggggtgggtgggccggagagtgtcgggacgggccccgcttacagcagtggggggacacgcatacctgctgcatgggtgctgccacgcacggcagagagcgtgcgacaaatcagggttttgcccggacctacctgctggtcgatccctccctatgacccgatctggacagcctactactacgccccgcacgcaactttagaggagcgcacataagtgggctattctgccgacatgaatcacccggaccccaggcagaaaaactgcaagaacatgaagaccggccgccgcgctccgcatgtgcacagcggccggatggaacgtacgtgatgcacaaccaggacacagttatcagcagcctcgcacataccagcagcacagccacaccctacccccatgccatccctgaaacgctggcttgcttagatgctcaacgcaattcgtgcaccgccgcacctgctgccgaaagctagtcaagcacgcccttcacacaaccgccaccattacagctcttacttcaccgggaactctgcagtcacccagccatggccaggacgcccaccttaacaaagcatgcccttttgtgagagtgggcccaggcccagcgcgcctaggtgcgctgtcagcctccccactctaagtgctgggggacaggggctcagtggcggagaccactcgtgtggcggtctctcatgcagtcatgcccccatgcccctacctcctcagaacacgccctgtcacgcactcattagttttgccgggacgggcggcggggagagcgcaggcgggacgggtgggggtcgccaaaagcctggtccgacccctcgttggttctcagagaagggattcggactaacttcattcggacagcgggcattcagacggaactgagacaggattcggacgcgaggctttcccgatgtatggacaggttccactagcatggcgtttgactgttgtgcaaacattcatgcatgcaccatatgtgcaggtgctggagtgccccaaccccgactcctgcacgtacgacgcccgcgaggactcgctgcgtgagatccaggcggtgacgtggtgggcggtcaagtggatgcagggcaacgcctcacagcgcgcctccatgaacacactggcggtgagactaacagcagcaactcgctcaccccaccgggtacatacgtgccgttgttctgcgctctgcctacctgtgtttgtccacccacacactcatcacgcaccttcattctgccgctgtggttggccaacgtacattacggtaatgggtcatcatgggtaatgtcatgtcctactacaggggccgcgcagcccctttagatagggcaaaatgaaatcaccatggccgccatgcgcgatcccaccccctccacaggaccaaaagtggaaagacctccttggccggcgccagcttcgaacgctgggggccaacgtggacgtggtgaagcccattgagacaatgagcgatgaagagttcgtgaacgcggtgtacaacctgacgtatgtttacaaccagaactacaccaccaccctgtgcgctgagggctacatgggtgagttgcttgggagcggaagcgcgatgggcggcgggggcatgcatgtccaagcaaaacccaggagcggattttgtgagtgcgacagcagaacatgctacacgcttcacccacacgccgtggcttgtcgaccgtacgtgctgtctcaccacccccgcgcgccctcatctgtgagcccgcccacacgttcatcattacaggcacgctatgcggcgcctgccagcccggctggggcctggtggacgaggccagctgcatcaagtgccccgccaagtccctcaacgacctgtactacgccctcgccaccatcttcaccatcttcaccatcggcatgacagtgctcagcagcctggaggcgcagaagaccgcgcgcgacattcgcgaccacggcctggacgtggcggaggtgcagcagcacaccgagaggctgcaccagctggaccccgcgggccagggctggcacggtgcgtgtgcgtgcgcgtgtgcgggtgtgcgggtgtgcgggtgcgtgacaagttggcgcgtgcgtgcgagtgcggcgacgtgggtcttgttgggagtgagggcggcggggctggttaccgtacgatgcaatggcctgatgcatggtgtttgctggggcttcatgtgtgtcgcacgcgtgcggacatgagacttacgtggtgcgtggtgcgtggtgatgaagggcgcggcggtgttcccttactttatagtacagggcacacggtggtcggttgcaatgcatggactgctggtggccggtggcaaagttctctgggcgttccggttgccgttgccgctttccacgcttacatttctcaaatgctcactaccccgcaggccaaacctcgctgaaccccgtgcgcgactccgtgggccctgttgatggcagccgcccgggcagccgcgccgccagcgtcaccgccggccccagctcgggcacgcagctgccccccgccgccgagggccccaacggcagcaagagccccctccgccccggccccgtggcggaagccaccgagaccgacggcggcgcgcccgctcccaccccgccgcccgccgcctcactgccaccggccgcgcaccagcaggccggcggcagcgccaccaacggctccggcgccttgaacgtcggtgctgtcgcgctcctgtttgacgggcagcaggcagacgctcacaagcccaagcccgacatcgcatctgccggcggcttggcgtccagcttccgacccgacaagagcggctacagtgcaaccgccggtgccagcggcacacagcgccagggctctgtgcagggaggcgtcaacgcgtcgggccgcctgccgtccaccaaggaggcgtacagcaagtaccaagggctgacggagtacgagattgacgagctcaagcgcgcggaggaggaaatgagggaggaggcgctcaaccgatacgctgccaaccagtccacaatcatgcgcatcttcatcagctacatccaggtgcggggtgggggcggccggtcggggccggtgcagccgggcaggccggcggcggcggagccagcattggagccggggcgtggggagcatgggcgcgggcgaggcgcccctcataatggagtagcgcgggctggtggaggagcggtctggtccggcagttagaatcgtgcggtgcggcgcgcttgagcccagcgtgaggagcgcaggatgcataactgcgaggctgacaccgccttgcgcgccggtgtcctgtcccttcctcaactctcctccctcaaatcccctcccctgcacaggtgctggcgctgctgcgcaacgtgcccatccgctaccctgacgcctacaacaactacctcaaactcaacaaccaggccaccgcctacccaggagacatcgtcaccatggactgctcgctgccctacttcgcagccggcggcctgccgaggtccatgctcaaggtgcgcacgtgtgaatgcggcaggcaccgtcctttcagcagggtagcaccgggcggggctcacacacgttggccaggcgtggtttggcaaatgtgtcccgtgcccgcccgcccgcccgcgtgccagctagcccacctactcggcttcacatgtccacccgcatgtccgcattgtccgggactcgactcaccccccgactattgtcgcgtgccactccgttgtcaagcatatgccacgctctcctccacgctctattgcattgggtttggtttagtttgggctggtatctacagccccacccccacccccaccaggtcatcctgagctgcgcctcgcctctctacatcctgttgggcttcgccatcctgacgcttttcggcgacatggccatctactacaagaagcggaagtgagtgccagcagtgatgccatgggttacctgggttgcaggatgccagggctgcaggagaatccggtttctccgcatgtgcacgtgcatgcgtcttgcggttgcagcagaagaaactcagccgcgccgctgacgctttgcataatgtgttttgcctagtacgacttatgacaccctgtacggtactcatgcgcgcatccacgcaggtcgcgggccaagctgatgaaggcgaccaagaagcgcgggatgagcggcaaaggcgtgccgctgggcgagagcgtggagggtcccgagccctacgccgccgccatcaccactaccacttccaacaataacaacggcttcaccaccgtgaatacctttgcccgaacaaagacctccggctccgccacggcggccggcggcgctagcagcctgcctgtcgccaacagctttgcacccggcggcgcccagcctgtgtatggcttcaactctggggccctgttcttcggcctggtcaaggacaactactgccccacgggccgggacgacccactgcgcaactacggcgcattcctgtgggaccgttacttctcacaggtgtgggcccagaggagggtgggggcgggaaggcaggccagggttcgagggaggcagagagagggagaggaagggagaggtaggaagagggatggacagcgaagggttgagagagcaagggtgagacgggttggccgcaacttcccacagggaccttcaatctttgcgctcttggtacacccaccttgcaggttctggttatgatgattgtcatcttctttgttctgtacccggacgtgagtaccgggcagggagctgaggcagagggtctgagcccaaacgtgtcttgaacgcgtgaggatgggttgccagcaaagaggcccgcgcgacgtgtcaggagtaagctacacgcgcgtgccttcatgactcactgccccatgccgcgcttcatccgcgcttcctctgcttcggcctcccaggtggtggacaacctgctcagcatcttctcgtgcgctgacgtggacttcgacaaggacggcaaccccctggcggtgggtgtgcggggctggctgcggtgatggcgacagtttacggcggcggtgttgcaaagcatcaatggcggcacggggcacggacgttagcacttacatgttgattgccgccagacacacatacacatgtgctcgcgcgcaggtcaagatgggtctgtacaacaagcaggtctggacggtggactacaacgtcacttgctacgagggacagcactttgtgttggccatggcgctgggcatccccgggtgagcaggaggcgctgcgtggcgtggtgggcgcgacagggcgggaaaggcctctgggcgacgtcccaggggtggctccttcattcctcgtgcttgcatgccgcctgggtcccaccgccgccacgccacgccgccccgcccgcccaccccgcaggatcatcctgttcgctgcgggctggccctccatcaacgccgtgctgatgagcccgctgggccgccagctgtgcggccacaagacgcgtttcactgaggacatgaccgagtactacctgaacgactacaagcccaagtgagtacggactgtgccgcaatgtgcgggaacttgtagaggtgaaaggaagcgcggcggtcgcgacgcacgctgcgttcagctcgtacggacggcgtgcggacgctataacttctttatttcacaaccgaggactcggcggtcttattaccggtgctaggcgcttgccagtttgcttcatctatctgacccgtgcccctgccccgcgccccgtgtgctcaacccgcgctggtgcagctttatctggtgggagtcccttgtgatgctgcgcaagctggccatcgcgctggcgaccaccttcctgggtagccgcgataccgacaccggcctcaacctgctcatctgcatgtccatcctggtggtggctgtggtgggtgccagggcgtgttattcgcgagggcacatgcatgtgtgtgtgtgcatgtgagggcacatgtgtgtgttgtgcgtatgtgtgttgcgtgtgtatgtgtgttcgtacaccgtatgcccactgccaggtgcacgggcgagcgaccaaggcgggcgcatcacgcacccgcagggtcccagcgtgccttcccacacacctcccgctggcacttctccgagtccgggataccacgggcatagcactgacccgtctatcccgccccgcccttgctcccctcctacctccacctccccgcacacgcgaccgcagtcgctgcagctgtggttccggccctatcaccatgtggagaccaacacgctggaggccggctccatctgcgtgctgctgctgacgctgtacctgtcgctctacttcctgctggacgcgagcgtggtcagcaacagtggagccatcgccgtgtctgcggtcatcatcggcatcaacgtcggtgagcagggatacgggcagctgggatggttaggggatgagggcagctcggatggtcaagggatgttggggatgtgtacgggaagcttgcgtgtggggcaggttggctggtggcatccaagtgtgcacgtacggccttcagttgcgcgttcctcgagcatgcatgcataccgtacacttaactgcctgtcgcacgcgcctaccccaccccactccatgcctccgatggcacgccctgacacctgaccccttcaccaaccccagcggccctgaccccacgcccctcgcccctctgcgccgccgcctgccgccccctcactcgcagccatggtggccatcttcctgtactacgtcatgcgctcccactggcacacctacatcaaggacatgggcttcgatgcggaggtgcttcacggcatgtcgcgggcccagatccaccagcacgtgagtaatcccttgatccctgaggcttccgtccggagcggcgcgtgtcaattgagcttagattgctgtcggggttgcgacgaggcgcgctggttgattgcccctcgcgcgcacatcccgcccatgtcgccggcgtcacccgaaccccgaagcgctgcctggcaccccgtgcggcgatggcggcagggcggccgccgcaacctgtgttctgcgcgctgggcttctcctcccctccaccttatgccaccctacagccaagcacgcctggcccatgccaaccatggcgcctaccaccgtcagcactcccattccccgctacccatgcaccaccccgccctccgcggccctgccaaccaccgcgtgccgcttgtccccgtgtcctttccacgtcatcacagatgtccaaggccatggatgacgcgctgcccagctttgtgccagagagcgtcaagtccgtcatcacgcgcgccgccacaggcacgttggcacacacggtggcccttcagaagcgcttctcctcacccgccagcctcaccgtcggcacctcggccgccacaatgggcacacacatctccggcccgctcagcccgaactcgccgtctggcgccaacggctctggcagtcccaaagtggggaccgtgaactcccttggccggccgcagcagcagggccagcccgaccgcgtgaacacgctggggcgcggcaaggaggaggcgaagcccaagcaaagcatcaaccccattgacaggctgaagtcgaacaagtag

SEQ ID NO: 11 - DNA, 2775 bp, Chlamydomonas reinhardtii
atgatgaaccgaaaagcttggcataggatggtgcggcaagtggaggtgaagaaggccattccaaagccaaaagagatgacctgggacgttgtactagacctcgcaaacgatggacaggagcaccatgaaggtagtaacaagctaacagcagaaggtgcgtcgacggtcgggcaccgacggtggccaagggcgggcggccacaacagccggtcgctgctatttattagttaccgcttttgtcggatggaaggtgctggtgctaatttgggtgtggttgagggctgggcaatacccacgccgttttacacttctgcaacctgcttcgcggtgctccacatagctgctcgacatgactcgctgataatcttcaatgttgggccactggtgctgtcgcccgggggtgctttggccctgcccccgcctgccacgcttcgtgccagaccgtgccgtgtatgctctttacggcgctgctcgttcgccctcacgccctaattgcagttgagacctgtcagcccaatttaactaatgcacctcagctgccagcagcttgcgacacggtttcaactcctgctgaaccaccactgtgactacaccaattgccgccagtactgatccacccacgtgatccacccctgttgctggcccctctgctgtctatccacgctgcagacctcgtccgtatcaggactgcgctgcacatgctggggaaagacgagccagagcatggcaaaacggaaatggataagatcgcgccggatgccgtggagttcaagttgttcaacaaggccaccatggaccgcggagacctggtggccttcctcttcatcatgggagtggtgagtggccgagtgcggcttgttacgctggaatgctgcggacgcaaagacgtgttcaggtgtggctgatgccctacagaggtttcgcgaataccgtaaaggcaggcccgtaggctcatgggttggacggtgatggcgtgtcgccgcgaagcctggtcggcacggcagccacaccaccactcgccctctattctgtttgcatgtaatacacatgtaacacacacagtgtggaactccgttgtgccacctgatttgataatgaatgctgcaacgctgtgccgcgccgcacagagcgccacggaggacgcactgcatgcggagctgcgctacctcaagctcacgagcgacctcatcacgccggcgcaggccgtcttcgtgtggtgagcgcgcggcgcgacacggcgcgcacgcaggcttttagtaggcttttgagggcgagctcagtgttaagatgatgccagtttgaactgtggttgtactgccgttcaagtgcggttgaacacccgggacaccgctccgttgtccatgtcttgggaaaggctcacaccatggaatggctcactgcgattgcttttttatgacgccttggccttgcgcatgctccccttgttcgcaacgttgaaccgggcctttcaggatggagatgaaggacgacgaaaaggatgaagacgctatcctcaagcgcgcgttcatgttctttgacaaagacggcaacggtgagcgcgcgggcctgctggtggcgggctagctctggtagcgaacgggtacaagcagcatatgcataccgtatgttgtcgacttggccactggtcgtgatgctgtcaatccgtttcggcttgcttgcaggcgagatctctgggcaggtgcgcgttgaggccagcgacatacaaggctgtgctgggcgggcccgcagcaaaagggtggctgcacagctcaggggccgtgtcgctggtctgtcagtcgctgttggacgcacgcccgttcgttcgctagctgcaccgcgtacacaccctttagcgctgcgccactgtcaccaaccagcaacctcctggacatcattgtttacaactcacaggagctgcggcaggccatgggcgacgtgggcaacatgctcacgggggccgagatcgacgagttcatggaggtgaggcaggacacgcgccctgggagaaacgacgcgttgataggcgttctcctagcatactgtatgctgcagcggactcggttggcaaagggttcattggctgtcggatcatagtggaagtaccgtagatcttgggcgcttatgccgtagcactgcggtttgacgccaagatgtcaccccggggctcagccccgggggacccattttggttgggggactggcgtgactgggccgggcacacgacacattgtggccttatcagccccatgcaccctgtagggcatctaagcggctgcgaagcgcagccctaatggcattcatgccttgcgacgtgctgtatctgtccttgcgatggccactcttgctcctttgcccccacagctgatggaccgcaacggtgacggtgtggtgggctacaacgagttctttgaggtgctcacgaagcagaccgacctgggccaggtgctcaagtgagtaccgcatataagagttacgcaacctttcgtatagcgtatgccgtaatacggtactagggcggggcatgatgcgtggcgagctccatcaagtgcactggttatgggagggcgtgcactgcctgtgtactagccggggtatcttgagcaacaccccggggccgccaaagcacgcgggccggctgtgtggtcccctgatggacatgggatgattgctacggtctcagcgcctgcgcctatctgaaatacttgcccttgtcttctcttccgcagcgacgtcaagaagctggacaaggacatccaggacatgttcaattcttag

SEQ ID NO: 12 - DNA, 2896 bp, Chlamydomonas reinhardtii
atgtttggacgttttcgaggcttcagggaccgcctcaaaaagcgtggccatcatgtcgaagaagagttgacgctagaaaactcaaatttgacatcggcacaaataggtaaggatagcgggcactcgaatgtcggttcgggcacacgagcagaggccgcgcggaactgcgactcggacgggcccttctacagtcacccagattgagcgccatgctgtatgtgcgaatggcgcttgcccgcagcgacggccctgaaggccctcaaaattctagggctcgagcccaagaagcagcagctgaacaagcaggacttcatcgtgtttctgtatgctatgggcctggtgagagcttgtgaagcgggcgggcgggggggggccgggcgggagtcggcttggacgacgcggtggactgggtagctggggcacgcaggccgccgtgccgtgtgcccctgcacaaaacaggtccgcaacctccgtgcttaacgttgaccctctagctgaaatgaggggcttgtacggaaaaaagaatcttccacagccaggaacgcgtgctgtgggaagctcccttcatggttaagctgcgttgcgttttctcaacgactaggccctgctccactccggcacgcagaaccccacggacgacatcattgactccaaagtccgcgccttcaaactgcaccacaagaagacattcacgtttgggcagctggcgcacgtatggtgggtgcccagcgcgtgtcagcagtgcctggatcgggggcggtctggaggcgttcgtttggttttcgatcagggagaggcgtgagcacgggcgacggggctgagggcggcgccaggagactgtaagaggggagcactcagtgccaataagactagcatccggagccacataacttgatgctggacttcaccactgcgctgttagaacgtccgggtataaccacctgccaactgcgtgcctgcgccgcatagcgactcctgcagactcacaaggccttgccgtttgaattcgtgcacgtgcgctttgcaggtattccatgctgcaggacctgacggatgaggacgagattctcaaacgcgccttccagttctttgacaaggacggcaacggcgagatcagcgtgcaggtggggccgcagctagctatatggtaaggggccaagagggggaaagccgttcatggtaaacggaaggggtggaggtggcggaggaacaggagaggaaggggacgggaggaggggacggacgcataggggggggcggacaaaatggtgcggcagagttggtgcagcggggccgggctgccgatgattcgcgaatgccgcgcgccacatgtggaccatagcttccaacgtatccggcatgtgttcagcgctgccgttgctgctagaccaacacatacgtacatcggatgccgtatacaaacctacaggagttgaagaccacgatgcacgagctgggcgacttgctgagtgaggaggagatcgcggccttcatggcgatcatggatgtcaacaacgacggagtgattggggtgcgtgggggcatgttgggccggaggggaggccgtggtggccacggggtaggccacagctgttcggctgttcggctaggattcgggccgttggcagagggctgcacggtggggtgggttgcgcccgagcgccggctcgggcaactcacggcagctcacggggtggccggcatgcttgagcagcagcccccggcaacgtgtgctcgcccgcttcccctcgtactcttcctccccaccgtggatcccccccggactcggtgcatttcggggatggggactacgtcgctgccacatcgttgtcaagcataggccacgctctcctcctcgctctgttgcactgggttcaatttaacttgggctggtgtttacaacccaccccctcctgcccctcctaaccggcccctccctcctcccttcacatcaccagtacacggagttcctggccacgctgaagacgcaggcgcccgagctgtcgggcgacaaccacaagctcaagacggcaatggagggagacaggaggtgaggggatgagggtgggggaggatagcggctggggtgatcgcgaccggaaagcgatgtggatgtggcaagacgatgccgtgatagcaattgcgattccgcaccagctgtttgtgttgctcaactggtgtgcagtgtaacgtgcgctcgcaatcgctctagctccattacctttcttctaaccttccgtatttcttcatttgcagtgtcgcgggcggcctcatgcgcgccgacgcccgccactatgaagacccgggcctgccgctggcgggcgccgggcccagcagcccacacgacacactgctagcggcggcggcggcgctgtcgccgtcagcccaccactcacccgccgggacacacaccgggctcgcgcatccggcgaaccaggcgcacccgcagcagcagcagcagcagcagcagcagcagcagcagcagcagagcctcaaccggcgacaccatcccgaactagaagaggcggctgtgcaaggcggccgggagggaggcctcaaccgcgggagcgagggcgagggcgtggggataccggaaccgtccgtagcggcggggatagggccgggcgcggtcggcgccagcaccggccggggcagcggcagcggcgaaggcagtgcgggcggcgcagggccaggctcgccgcggcgacaggcgtcgctgcgggaggcacaagcggcagaggcgcgaggcacagcggcgacgacagcggcgatggcggcggcgctgcagcggccgagcagcagcagtacgcgggacggggcggcgcttccgccgtcgtcaccgccgggcgtaggcgctgcgccgctggagcgcagtgggtccaaccacagcaggtag

SEQ ID NO: 13 - DNA, 4992 bp, Chlamydomonas reinhardtii
atggaggtgagtcggtgacgctcggggctcggtggcgagcaaggaccaaagaaaatgagcatccgcggccccggataatgcagcgaggcccctcgggtttctctgtgttagtcgaggatatctacgccctacaaaccttacccgggcgtaccccgggctggctaaatcactgggcgtggacctcgaagaggcaaagcgttcgacgtgaggcagcaggcctgcggctgtgcggcatattcaattcgtcgttggctttttgcagagatgggtagctgctggtgtcgtggggcatttgactgggcgagcagctcggcgaggtgaccgctctggggcggttcacctcgagacgcctttagtaaatgccaatccataaagcataggttgaaaactgaaaaggaagggctggagggcacgcagctttaagaaaattgggagcgtcaactttcgctcgcccaggaagctgaccccactgttgcggtggcggacgtagtgcttttgaccgtgcatgaggtgaaatattgttttgtgtgctctaaaacagctagtgtcgggtcttgcggcggacaaggcttgcactcgactcgcgtatggggttttcttccggttaccctcgccacccgcgccccaacgcgccacgttactccgaccggcaccttaggcagactgaacgcctcatgaacaactggtccactgtacatgtgacacctctacacctcgcagaaatatgagttcctcagccggacaggagagggggcgtatgggtcggtatggcgtgcccgggacaagaacacgggcatgatggtggctgtgaagaagatgaaggacgtgcctaccacagaagaggtgcgttggcggcaagctttgattgggtgagacctgacccacgttcgggctgtgtcagcggcgcggggccgtaccgccatagtcacctggaccggaatcggcagcgttggcatgagcgtaccatgtgttcgcgttaggccttaggggcatagcggctaacctgggctgttacgttcgcgggctgggctgggttgggcccgcccagtgggttgagcaacacgccaaacttaaggtataactgcctgtcctgtcacgcacacaggaaggggaaatcgccatgcgggaggtccgtgtgctgcagctggcgaaacacgtgaacatcgtcaacctgctggaggcatataagagtcagagtgggcgcctgtaccttgtattcggtgagggggggcctcgggtagcacaattggaacgtggagccgtggccgaggtcgcggctgggcgggcgcaatggcagccgggcgtgtactgctggatggctgacgtgcttcccatgcgcgttgtgtgcccatgcgcagagtatgtggagcgcacgctacttcaagagctgaaagccaaccgcggcggcatgccgcccgctgctgtcaagtcgttgacatggcagctgctgcagtcgctctcatacctgcaccggaagcagatcattcatcgagatgtgggtgcggttcatggggagcacggacggtatgggaaggagtggcagttcgggttttatgtatgggacgagccttttgcacactgcagccggcgccctctcaccgggcgccccatgattcgtctgcgcaggtcaagccgtcaaatatcctgattacggagagcggcgtcctgaagatttgcgacttcggatttgcgcgcgccatgaccagctcctccgcggacccagcctacaccacgtacgtggtcacgcgctggtaccgcgcgccggaaggtgcgtgggaagcgggctgggaagccctctgttccttgatcgctgcttgctttcgcgcccatgttcgacccagggctctggtaaacaagttgaaccttctaaaccaacattgcgcgtgcctcactgtgatccgcagtgcttgtgggcgacaactacgggccgcctgtggacgtgtgggcgctgggctgcatcttcgctgagatgttggcgggccggccactgttcccgggcaagaatcatcacgaccagctgtggctaattctcaagtgcctgggcaccatgacggagcggcagctggagctgctggactcggacccgcagtttgcgtgcttcaggcttcccacgcaatcggagatcgagccgctggagcacaggtgggccggtgcaggcagggggcagcgtgggggcacgccgcacaggggggacgccacaactgataccttgttatcaaggcatacggtaggtttgcctgccggacctggcgcttgaaacgagccccgtcaagcgctaacggtgttgtgttgatggattgcatgcctgcaggctgagcgcactgagtggaccggcgatgcagtttttacgggcgtgccttaacccggaccccaagcagcgcgccaccgcagacgagctgttggccatgccgtacttttcgggtgtcacggacgtgctgccggtggacgacctcatggcatacccggtgcgtgcatgtgcgcacttctgttacgtatttttggagccggggctgcgggcagagccgtacgacagcagtttacagtcttcgggttctaacatgtgttcttgcgtgttcccttcaacaggacgccgacctgcgcgcaaagctggaaaaggcggtggcgcaagacgccgcggccgctgcagcagcagcgcagcgggagtccttgctgttgatgcccagcaccagcaagcgcggggtgctggcgcccactaacagcaagcagcacatgaacccgcacatgaacggccaggccgtgtcacccggccgcaatggctcgggtttgccgctggtgcaccaccagcagcagcagcagccgctgctccagccgcacagcagccagcccatggtgggtccgctcccatccaaggccgccagtgtgcagcagctgtcggcagtgcacatgacggaagcgcggccgccgctgcagcggtacattacggcgccggcgggcagcatcgccagcaaggtcatgtcgcagccgccgccgctgcagccgctgtcgcaacacggcggctactcgcaggtgccgcagccgcagcagcgctcccgcccgagctcgggtggcggtaacaacagccagcagccttcgccgtcgggcagcagcacaagcaaggcgtcgtcgcagcagcaggtggggccaccggggccggtgcgggatgagcgtgaccgcgagcgcgaacgggcgccggcgccgtccgggaacgcgctggtgccctcaggcatgaacggcatggggcttggcagcggactgcccatgcggcccacgcgcggcacgtggcgattcagcggggacggcgaggcgggtctgcctcccaccatcactcgccagctgtcgggcacggtgaatttccagacctacagcggtgcagcagctggcggcgggggcgcggcaatggagcaggggcgcggggggccggaccacgtgacgccctccctgcgtgcaccgcagcagcgcaccacgtggaatggcgctgcgtcagctgcgcagccgtcgcaacgaagcggagccagcaacggcggaggcagcaacaacaacagtaccagcggtcaggaccagggccagtcgcgcagctcgagcatgaacgggcaggagcagggcagcagcactgctgcgcaccgcaaggcgcacagcctcgcgggcaacgaggggctgcacgtgaacggcgggggcggcggtagcgcgacgctgcgcaacggcgtcgcgcctggcggtctgactgggctccaaggccgcagcctggccccggcgccagctagctccagcgggcagtcacaggccacgcacccgggcttcccatccgcaaacgcagctgtgcggctcagcccctcgccgccgcccggtagctatggtggcccgctgcggtccaccaactcagcgtcgctggtgcagccagccgcgcaggcctcacagggtcgcggcagccacgacggcatgggcaacggcccctcgggtcagctgctactgggcccgtctgtccacggcatctccatcgtgtctggcggtgggggcggcggcaagacatccaacagcggctttctgccgcagcccgggtatcccgggagcacctccagcatgcacgccggcggcctgctggagccggaggcgtcggactcgagctgctacgcagatgcctctgcctacctgaacgacggccggcgtgcgtcagacacagtgctgtacgcggcggccgccctaaaagaggcgaagcataggcttgacaaggcgtcaaacatgatctcagggaccagtcggccgccagggctgctggacggcgtgccggtcgctaacggcggggcggtgggcggcacacttgacgggggcagccgcagcgtggggctaggggtgctgcgcgcgccttcgtttggcaggacgtctgggccgcccacgggcattccgaacggcccgccgtctccagacaccgtcttgccatccaacctgccgccgctgatgggcggcacgccgcgccgcatctcggcgcccgagtcctccaccacgtcgggagcgctggcggcgttgaacaacgctaccaacggcggcggcaccggcgcgttaggcgcaggcagtggcagcaacagtagccgcgcgctcatgggcagcagccacccaccgagcggtggcggctacctgcagcggcacaacaacaagcaacaacatcagcagagccagcagcagcaggcaaacctgcatggccaagcattggcgcagctgccgagcatgggcagcggcgatagcgacgagggggcccaggctgccaacattagtagcaatggtgcctcccatgggaccttcctgcctgcgctggaggtcgggaagccgggcagccgcataccgtctgcatccctggggtccacgtccggtgtgggcgtgggccgtcggccaagcaagggctcgctgcgctctgtgggcccggaagcggcccactgcaagcgtgaggaggccatgaaggcgcttgccctggaggcggtgccggaggccggcgttttatga

SEQ ID NO: 14 - DNA, 2046 bp, Chlamydomonas reinhardtii
atgtcggccaatcgtcgcagcactaatagtaattctgcatctggggcgcggaacggtgctcgaacgagcagctccgcggacaatgtgaagaagtgggtcgcggaggacactcgagaggagggcaaggctgtttttaaagcacacgtcaaggagacaagcaacttggatgttctatctcggtgcaagaagctcaacgagcttttaagcagcgtaagtctctgggcatgccggtttgggccgctgcctctcgctgcgttcccacggtgctccaatgcgcgtggcgggcctggaaataggtactcacaagcgtggccgctcagtaccaggtgttcttgttgacagcatagtgaaaaccccgaaccaacccaggcccttgtccgcgtccccgcgcccacaggacgtgctcaaaggcaaaggggactccaaggagcagctgaaggagattctgggcattttgcactcgggaccaaagcggccctcctttctggacaaaccgccggtgacggcaactgcaggcaagcggccggtgccggcgcaagcagcgcagcctgttgcagcagggccttctggacaccttgatgcggatgcgctgatgcggctgttggactcggaggacgcggaccaggcggcgaggtaaggaatgccttgtgtgcaacagtgcgtgggagctcatacccgtacttgggagctcatacccgtacttgcgcctcgcgcgggcggcgtgctctgcgcggccatgctcttggcaagccggtaactgtgatgtcatgtgaacggtgtggccttgcgcagggcgagcccaccttccacctcgcgcaccggacaacctcaaacggcggggccgccagcagaggacgttgacgacctcatcaacctgctcaatgacgcctcgccggcacccggcaacggcgcattgccggtgcagcaaaagcagcagcgggagcgggaggaggccgagcggcagcggagaataaaggaggcgcaggaggaggcggagcggcaccgcaaagccaaggaggaggcggagcggcagtggaaagtgcaggaagaggcagagcgccagcgaaaagcactggaggacgaggctaaggctgaggcgcagcgcatggatcggatgcggcggggcgcagcggtgtgcatccaagctgcctggcgtgggcactgcgctcgccgcctagcagcggtacggaggaagcagcgcgctgaacagcgggcggcagaggtgcttcaagcggcctggcgagcacggggcgctgcgcgggagcatcgtgcgcgccttgccgcggcggcggcgctgcaggcggctgtgcgggcgtggcaggcgcgacgggcgctgcagcggctgcgcgtgcaggagttccggcggcagcacgcggcgcggcttatccagcgggcgtaccgctactaccgctacacacgcggatacacgttggggccgctgagggtgccgccgcagggtggcccgcggcccggctccggatcgggtgtggacggcgcggccttgctggcgaagcagctgcggctgcgcagcgcggtggacgcacggctagcgcccgagacgccacaacaagcgcagggtaagtttacctttgctctggcgtgttagggtacggtatagcttacagttctctatgcggactcctggccgcctgaatggccgttttgactttcttcctgccatgttcttgctccatttcgcattcccgcacatccagccatcgtgcacgcacccaaacttactactctgccgccctgcgacctctgcctctgcggcaacgttaacaggggacgacgatgcctcgcagcaccgcacagtggccacgcaccgtgagcgcgtgcggcaggtgagcgccaacgagcgcagccgccgcgccgatctcggagagcgggcagtcatggcggggtctagccaccgcgacgaggtggaagccatggccatagcacgcacgggtatggtttctggaccgccgccctcaggacccggcagccagctgccgcccacgcaacgtgtgtcgtgcggcggtgacggcggagggcggccgttga

SEQ ID NO: 15 - DNA, 1942 bp, Chlamydomonas reinhardtii
atgccgctagtatatgtaagcgtatgccagggctctgtggcgctcgcggagtatgcgggtgagagaagcattcggtcgcgaagcgtgtgcgggagcttcgcgagcgacgctgcgctaggagcacctttttggtcgacaaaacaagttagcgctgagcaacgggttggggctgtcgcgggctgggatgctgcggaagctgcgtgggtgccgtagaaccaggcggcacgcaggcacccctgcgtacgcgccctgctcccctgtcgaacccccatgtagcccggcgccccctacgtaccggtctatgtaatatccgtggcgttggacttctctgtattccattgcagctgccggatcaggcgcataccacatcgcaaccccgctacgatgccttgtccaaactgccacatagcacgctccgcaatttgtagatagcaagcctaggcagcatccctacagtgggccccggagaccgcaaacatgcaaccaaacacgtcatgcattgcgcctgcgctcacgcctacccagaactattgcagcactacaccaacctacgcggacttacggtatcatgtccatcctgcaaggtgccacacgcccgacacacccacacggccacatagccctgtattcctgcgcgccacgcgccgtgacgtagccttactgcgcctcactctcttgacggcatctttatcacaactcaggcttccaaggcaactttgcggtggttgctcgcgattatctggacaaagccaccaagctggagggcaagagccgatacgaggttgatggccactccctgaacttcctcaatcgcggcggattcagtgagtctaagcctcatgcgcaaccgatgaatctctgattgatggcagcagcactcagtgagcactcagtgagcactcactgggcactgatctccatctcatgccctcctctccctcccctccatcccacctctcctctcccaccccaacccaccgctgccgctccctctcccccagcctatctggtgatagccagtgtggacagcggcgtggcgctgccctccgccttcctggacaaagtggaggcagagttccgggccaagtacggcgccgggctgcagctgggcgcggcggccggctcgctgaacgccacattcggcaagcagcttaagcagttgacggagaacgccacgcagcacccggaggagttctccaaggtcgcggccgtgcaaaagaaggtgcggggggagctgcagagtgcagactggtgcaagcccagggctgttacgcctgcgccggctacggcatgtggccctatgccttatcaccatatgcataacgacccacagcgaccatcactttacacttaaaatggctgtctattggcttcttcggtggttctatctgtgtgcgtgtgcctgcaggttgacgaggcgaaggcggtcatggttgacaacatcgacgcggttttgaagcgcggcgagaagctggagcagatacaggagaagaccgaggacctcatggcggaggtgcgggcaagatttgtgcatgtgtaacaggttgggaaacttccatatgggctgcgtggatgtgtggatgtgcgtgcgtgtcagggagggagggagggctcccgcgtgcggaacagcggaagggcgccgcgcgtaagccagagccgctgtggatgagtgtggacagagcggcatccttctggccgttgcgccgcaccacactgctctggccgccgtgtcacgtgtgaccctgcaatcaacaagccctcgcccgacccaaatgaccgcgcgccacaggccgaccgcttccgcgacggcgcggtgcgcgtgaagcggaagctgtggtggcagaactgcaagatgaagatcgtggtggcccttgcggtcatcctgctggcggtggtcatcttcctgctggtctgcttctcgggcggcaactgcctcaagtga

SEQ ID NO: 16 - DNA, 1202 bp, Chlamydomonas reinhardtii
atgataagatttgttcactgggtgagtgagccggagcagaactgaggggaagggggcacgcgttttccaggtcacgcctgtcaaccgaccggcacgaggttgtgaccttgtgtgcaagttctcccaatcttacaggttcgcaccaacggcggctggcgcttcttcgtgcgcctcttgttccagggctaccagggcggggccgctggcgtgggcccgttcaggtggcagtggggcccagcagcgggacagcaggcgggtcagcagggtgctgggcgacccggcgccagtcgccgccgcgtgacactggaggaggttgcagacgcgctagctaagctgcccacggaggcatacatgacgccgcagcagatggcggcactgtccgtgcacgagcttaaggtgggctggtgtgcaaggcctgcgagggacacgcacgtgctgggggcacttgtgcttagggcgcgtgcttgagaatgggctgtcccaatatggtcagccgcgtgtagctgagtaaggtcgcaggcgatggcgtacacgccaccaaacgtggcttctgctacgcctgacccaacgccctggcattgcaggcgctgctgcacggccgcggcctggagccggtcaagtgcctggagaagggcgagctggtgcggcagctgctggagcacggcggcagcagcgccgactcgtgcagcatatgctgcgaggagtatgcccagcaggcgtcaggagccgctgctgagacggcgcagatgccagcggcaggaggagcggccgcagcaggagcaggcgcaggagcagtagaggcggcggcggagctggggcatggaggcgccggatcaactgagtgggtgacggacgtggcggagcggaatgaggctggggccgaggaccatagagcgtccgtggctagcgcggcaggggcagaggctgggcccgcgtcccactgcggcgcgggcggtggtggcgccagcgctggcgagcacgccgtcccagccaatagcggctgccgagccactgggggcatcgcatctgatgctgcagcggaggcggaggacgacgcgcctgttgtgctgcgcgtgctgcggtgtgggcaccgtttccacgtggagtgcgtggacaagtggttcctcagtgccactgactacacgagggaaccggcatgcccgctgtgcaatgcaccgctcatccttcctctccggcaatag

SEQ ID NO: 17 - DNA, 2477 bp, Chlamydomonas reinhardtii
atggcgcgattgcaagcaagctttgaagccggagcgagccgcaggtagataatttggcgctcaccacgggggcagctctaatgtgtgcacgctgttaggaagaacgaaaatgacgcaggataaccggccgcgacgggttgtagggggcgcaaagccccgccgcaacttgggcccgggtgttgcgtggacgcgagtcggcccttacgcgtcccctgccaccccttacacgcagcggcgcgctggctagcacttcccagcgacttgttcgcagtcctgtactcacagcagaagcaccagcaggagcgcgcttggcactcagggcgcttgcctgcggcccgagcacccacatctgcccgcggctgctggcagcccacagcgctgcggcctgcggcgcctgctccccaacccgcagctgcacacacgccgcggcagagccgctaggccagacccgcaccagcggcctcaggtgtgctgtagtagctagcgcgcagcggcgaggcggcggcggcggccggggcagcaagtgggacagtgatgaggagctggaggaggacctgggcggcctgcgcttctccaagcgcagcggcatgtggcggctgcagtacaacaagtacggggcagaggtcagtgaggagcagtagcggcaggcggtagcggccagcggtagcggcaggtggcggggagtgtcggcacggacttcactgacgcctgggctggaaggagatttgactgccccagagccagctgggcgacggcacgcaaccagccaccagctgccgcagtccatctcccagctctcaaccacttcccctacccaccattccctgtggtcccatgatgctgtgctcctgccgggccctgaacactcctgtgtcactcgggcgccgcaggtccgcgaggacgaggcgtggaagctggcgctgccgctgctgggcggcctggtgctggccaccacactcataggtcaggcccggagtgtgtgtgactgtgtgtgtgtgggggggggatagttcattccaatcctggggaccgtgcagtaggggagcctgatgagcaggaagcgcgtgaggggcggaggggcagcagccggcggcggtgtggcgccctggcgcgcacatatggcgctggctggcgagaagggggtgtcggcgccgctacagctgcacgtcgccaaccggagcacccccgcaagcacacccacacagcacaccccagaggcacccgcactcgagtgaacgccaccgcaccctcccgcaccctctcgcccgctcccgccccgctcccgcccctcaggcccgctcatcatcggcgtggccttcacggcggtggctgtgggcgcggcgctgtccgcgggcgcgctgttcacctcgctgttcctgcccttcttcctgctcatcggctttggcgcgctgttctggggcggcgtcaccttctccgccttcgccacgctgggcgccgcgctcatcatcaagccgctcatgtcgctggtgggtgggaggggcggtgggctgtggataggggctgtgattggggctgtgattgaggctgtggggtggggctgtggggtgggaaacaagatttgggtagtcgattgcaagcacttgcgatgccctaagggcctgcctcttgtgtcccttactgcgtgtgttaggcgcaatgcatttgggaactgaaactgtaccgctagcgtgtggcatcactgacagtctgtctcatcgggctgtggtgatgcagatggtggccggtgcgggtctgggcatgggtgccctggctgtgggcgccttcctcaagcccgcgtccagccgggccaaaggtgggtctggcgccgacacaggaacaccaacctatgctccgctgcagtccacttgcacccgcgctatggctgtgcctccgaccctgtgttgcatagcacatgtttcaaggcacatagaggggaaccgcgcacgccaggacactgtgttattatgccatgcggttcgactcgagtccagggcaagtggatggtcgccatgacgtgtgctgtgcgcctcaacccgggtgccgtgtgtgcagcgagctatgaggagaaggctgcggcggccaagtccggggccaagcagcagggcgatgtgatcgaggtggagccggaggtggaccccgaggtggacaggtgggaggggatgaagtggatggagcgggtggggccgtgcgggcgggacctgtgggaaaggcgtacgctcacgctttttggcgggggcgcggcgtagcgacgcctaacaacccccaggcaatggtacgggggccctggaagcagcgtgcgtggatggcggtcgtggtcaacaaccctggggggagatgaggacttgccggcctaagagttcctggctccttctgtccccgtccggaccctcaggcagctgcgcgagtttgacgagctgctgatggatcgggagcagcagcgccgcaagaccgaccgcttccggcagggcggccgctga

SEQ ID NO: 18 - DNA, 14274 bp, Chlamydomonas reinhardtii
atgccccagctgacacgcgcacggcctgctgctcacgtaggcaatacgaacgacggttcgcaacaggcagccggggcggctggcgcagccgcggccggtgccccagaccccaacgaccccgacgcagcggcggcacagctgggcccctccgcgtctcgcgcgggatctcaggcggggtcacagggcggggcgccgggggccggcacggagggcggtgccggcgcagcccccggcgcgggcggtcagcctcagggtccgggcatcatgcagaaggaggagcgggacgcactgcaggtggccatggtgtcctacgacaacagctacaaggtgcgtgcattattgctgtgaggtcgctcgtgtttgtgttggtaggataggcaggatggggcaggatggcgccgtcgggcgcaggcgaggccgtgcgtgggcacgcacggactgtgaacaggtatgcatgctagcgggggagcttgggtccaccgcccaagagaccacgcacatgtttaccctgcgccctcccaccaccccaccctgctccttgacacgtaaacagctacaagaggaggcgccggccgtcaccgccgccatcatcctgcacttcgacaccggccgcatcacgggcgcgccggcgccgctgccgtctcgcctgacggcgcagcacgagggccgcttcgctcgtgaggagctgggtctgtaccgggagaaccagtgcgtgctcagcgaaaactccctcaacaagacggagcagcgcatagccaaggcggccacactggacaggcgagcagcggagcagcgggcggaaggggggacgaagagggggcggaagagatgcgatcagatgggggtgggtggtcggggcgggcggaagcggccgcagagcgagtttagggggagggaaggttacgatgcatgcccgctgcagcctgcttgtgtgctctagtacacacatattgatggtacccaaccctgtcttatcctctcgttgctagggccttgctggcggagatggctggcggcaacgcggctgcgggcgggcagcaggtggccatcatggctcagcggcaggcggtgcgggcgcaggaggtgcagacgcagcagctgcaggtgggcgcactccccacactcacggaggagccggaggggcaggaggggcagctggcgcagccgccactgggggagcagccgcagcagtctccgctgccaccgggcgctggctcacctccgcacgggcagcagctgcagccggggcaacagccgcccatgacgccaggaggacccacgctcccgatgccgcctgggcccggtggctcgcctcccatcatggcggcggcgcagctgccgttgtcgcccggggccgaggcggcggccattgccgcagccggcggcgccctcacgcccgagcagcaggcggcgatgcagctgcaccaccagcagcaacagcagttggcggcgcagggcattctgccgcctggcgcgcagggcgacccggctgcaatggcggcgatgatggcggcaggaggtggcggcggcggcgttgatcccatggcgatggccgtggcggctgctgctgcgggcgctccggccaccaccgccattcaggacccgctgtttgcataccagtggctggatgagaacggcctgatggtgtacgtgcctgaccctaccaaggcgagtgaggcattgggggggatatccgcctgagccgactggggtggaacagggttgaatgtgaagaggattggagctgggatgtttccattactagcgttatgccagcctctgatgcctgcttcgcttaattccgctgcttcccgccttccccgccttcccgccctccttgccaccccccacccccccagcgcgacaaggagcgacccgcccggcgctatgaccaggacaaggagatgacgcggacgtatgtgcggcggccggtggtggacgcggtggctggcgcgggcggtcgtggcggtcgcggcgagtcgcggctgtaccggctggacatcgagctggggcggctggagttcggggtgcaccccgccatgagccaggaggacctgctggtgagaggggggaggagaaaagggctggcggggggtgggtagtttatttcagaacccaaagcaagctgaccggggtaatttgtcccaagccttagcggccccaggggtttgatgatacaatacccagtaggggaggtatgcccgggcctcagtggtaggtcccagagggacaggagggcaggaaggtgcaatagggacgagagagccaagatggcggcaggggggcaggcgtgatggccaagagttgaaatggcgaggggggcgcgacgggatggtgtgaggagacagggtgggaaaggcaggtctacctgtgcctgtgttgaccgcggtgtgtggggctgcgatccgaggtatatactactaaatgcccggtcacaaaccttccatggtttctcgcccaggctgcccggctgatggccctgttccgcgagtacaagaagcgcgaggcggtggggctggtgctgttctacgccggccgcctggccgcgctggaggacagcctgctgggcgcgcgcgagaagctgtttgcgctgcaggccacggaggcggccgctgacgatgtgctggacgcatacgcactgctgggcaagattgagcgggaggtgggtgcgctcgaggggggcgctggggtgggagcggggttgtggataccagcccaaacttaaccaagggaaaccgggggaaggggtgacgagtaccatacgagaactggtgggctgaactgcttgatggcggggctcgctatctcctgtaacgcacggctgccggcaaccactgggggccgctggggccgctggggccgcgcaggttgcggagctgcgtcagctcaaggaggaggaggaggcgctgctgactcgcaccgtgcgagccatggagcgccagttcgaggccctgcgcggcattcggcagcagcagggctacgcgctaacaaacctggagctcacggtgctcacacgcccgccgctggagatgagctggaagcaggtgggcgggaagccaccggcggttgtggtggtggtggtggtggtggtggtggtggtggtggtgggggtggtggtggtgggggttgcggataccagcccagactaagccaaacccgccaaataagcggagcacaggcattgggcgacagatgcaggcgatagtacttaggggagggggccgaggcgtcttgggggcagggaaaggcaggcatgggctggcgcaggtcacacagcacgcgccgtggcgcgccgacggcttcgttgcatggagaagggcgccaagttgtaaggttcggtaataggggcgtgcacacgcgccctaaccaaccggccaatgccttgtgcagggcgtgctgacccgtgagcggctggacgtgctgctggtgacggcggagctggaggacattgcgggcctgcctcgcttcccggaccccctgcccgtgcccgacctggcagacttgcccctgccccgagtcaacgccgccgggctccccgccgccgccgggggcggctttcccggcgccttttcgggcgccccgggccccttcggggcgcccctggcgggctatggggcgctgatgtcgggtgggcagtcggctgcggctgcggccatggcggcgggggagggctacacgttccggctccggcgagtggagtccatgtgcgccgcgcacagcgcgctgctggcggaggcggtggcgcggctggatgcactcaaggtgagggcacggacccgtgtgtgtgtgtgtgtgtgtgtgtgtgtgtgtgtgtgtgtgtgtgtgtgtgtgtgtgtgtgtatgtgagcgggcgccggcgggtggagagtgcagggcgggcgctaccgtgcaccgcacctgccacccactgtctccctctgcgcccccacacctccgcccctgcccctccgcatcactctcccaccacgccctccgcctctacccggcgcagaaccgcccctccgccgaccccgaggacccggtgctcaaggcgctggaggaccaggtggcgctgctggggcgggcgccgcggcgtgtggccatgatggcagaggacagcctggagctgcagcgccgagccaccgagatggtcaaggcggggcaggtgggtgggcgggcgggcggggttgtttacaccatacctcgagaaagcaaactctgcccaccctcttctggccactgcccaccggctgctcaccccttccgccctctgcctggggtggtgatgtttaggcagagcgtggggccagtgggtgaagtggccagggagtggtcatggtacggcatgtgggagggccgaaaaggggggaggccgaacagctgtgagggcagagacctgcaccacacggcacaagcggggctgtaggggctgtaggggttgtaggggttgtaggggttgtaggggttgtaggggttgtaggggttgtaggggcagccagctagctcacctgtcgctgggcctttacccctgcccctgtcccctgttccctttccctgcaggtgcacgtgagccgtctgccgcacctggtgccggtgctcaccatcaaccccaccggcgctgcaggggggcacctgccgcccgcagcccagcagcagctggcgtacatgcagctgcagcagcaggggcagcagcaggggcagcagatggtcatgacgccgcaggggctgatgccggcgccggggcagcagcagcagcagctgggcccggggcagcagctgccgggagccgggccgcaggggcagcacatgggcgggccgatgggcaatcagcccaagacggtggggaaacagggcagcaagggcaggtgcgtgcgggtcggggcaggccggggtcgtgggttatggacagatgtccgttgcggcaacgcccgcgccgcgccaaccccctcagtatatggtatctcacaacctcaccgtcgcacttgtgcaggtactacgtgaagctgttcgtgaaccacaagttcgtggaccagtcggatgtggccacactggccgagaacttctcgggcgacttcaaggacctgttcaggtggggaccggtgcggaggaggaaagggagggagggagcaagaagcaggaggcgggtgggggctgggctggctgcttgcctgcaagccatgcgcggccaggagtggctaccctcctgctgccccccttctgctgcccccgggcgacgtttccttcactcttgggacctattttgctcgggcacattaacctcccccccccacacgaatacacatgcgcagcgtgcaagtgagccacttccccgagtccatcctggtgcagctgtatgagcgacacgcgctgagggactacttcgtggctcaggtggggcgtggcgagcgggccatttgtgggtgcggtcgtgtgttgcaggaacaaccgcgggttgcgggtttgggttttgggtttcgggggtgaggcgtgctctgtccggggcgtttggcggcaaggctggaccccatctcagccggatcgcgccaaactgctgtcccattccacccaaccctgacccgctccactcccacccccaccccaacccccaccccgcgcaggtatacgtggcggtgccgggcgtgtccggcacgccacacgtggacgccacgccgcgcccctaccagttcacctcgctcaccgctttccgcacccgcggccccaacaccagcaaccccaacggcggcggcctgtccggcgccatgccgctcatgccctccgacaccggccggcccgacggcgcgcccggcgccttcgccaccgtgttccccgccggcacgctgtacgtgcggtgcggctgggtgtcgcagcgggtggcggcgggcgcgagcctggaggagagggtggtgcccaaggccatgaccacgtacgacaacccgctggcggaccgggggcgggaggaggggccgctgggcacgtgggcggggcagccgggcagcggcgtggtgggcgcgccggacattgagagcgggcgcagcctcatgccgccgctgccgtccgtgcccgtggaccgcatgctgcgccgcgccgcggagcgcatcggcggcaaggtgggcccgaggagtgtgtgttgggggtgaggccagcgtagcgttgatggctgcttagatactgcacaggtactatcaggagttgggcactgcgacgcctttggccgcacctgagaaaggcgccacccgagcaggtgtctctgatttcttactggacattgtgctaccccccccccccccacactctctctcccctccccacctctccctacccctctccccattccctttgtttagtcatgcttgtaactcccctcccctcccctccctttccccctgccctgcctgcccccgcccaggccaaccgcgcccagatcatgcggtggctggcggacaacgtgatcgaccccaacgacccgcgcaacgccccgctgctggagctgctaaagacgcacgaggccgccagcggggcgctgggcgacctgttcaggctggacatattcccagacgtggccatgaaggtgggcagggtgtgtgtgcgcgtgtgtgtgtgtgtgagtgtgagtgtgtgtgtgcgtgtgtgtgtgtgtgtgtgtgtgtgtgtgtgtgtgtgcgtgtgtgtgtgtgtgtgttggggggtggtggtggtggtgggggggtatgtgcccgagcccaacgaaaaggtcccaactgtcaaggaatcctcgctcaacccggaaatgcagtgcgagctcggggcaggggggggggggtctcactggggtggttatgtgtccgagcccaacgaaatgggccccaagggagggaggggggtcactggtggtggtgggggggggcggcggcgtatttgcgaaggcggggatgcatgggggcggccaggctggcgcatgcagcggggggtggagccgccgcatcggcactgtcgttgtcgtacccacagctgcgcctgacacctggcacctggcacctggcacctgcgcctcatgcccccgcccccgctcccgcccccgcccccgctcccgccctcgcccccgctcccgccctcgcccccgctcccgccctggtgccaggacgaccgtgtggcggacaaacgcatgagtgtgctggcgcggcgctggcaggccggcatctaccgcgcccccgacaagaacctgctcaagggtgaggccgcgcccacagggcaacaccaccgcgtgtgcgcgcgggctggcggtcatgatgccagccacccggccctggcacggtcgtggccgtgtagggtcgtggaaaggccgtgcagtggactttccaataccctatcccttgcccgaccacaccgtaccgccctcaccattccgttcccctgcgtcttgcgcctccgcctctcgctgccacattccgtccccatcatcgcttgcaactagcgcctctgcttggtttggcttggtttaggtagttcgggctggtattcacaaccccccccccctgcgctgtcctgccctccccacctccccccctgcccaggcgtgcgctccgtgcccctgcgcgcccccctgacctccgaggagacgtcgcagctggacagccagtacctggaccagctggcgctgctggaggaggcggcggacggcacgcagctggggctggcgcgggtcatgatggcgcggcacgagaaggccatgcaggtgcagatcggtgagtaggcgagagggagagggggttgcggggtagtggcggggttggttgggggtggtaggggtggaggggttggtgggatggggtggggtgatggtgggatgggttgggttgggttgggcgggatgggttggggtggcgagggatgggttgcgtgggtgcgaggggagggggaggggggcggagcgaagcatgccaacagtgcgcatctagtgcgttgaacctgtcggacatgggcggcgggcttctagcacctcactcacatccctccctgcccgccccagccgccgtcctaacttccccgcccccctctcttccctcttcccccctgtctcccaaaggcgctcggctgaccaacgcaatcaaggagcgcgaggagcgcatccgcgccttcgccatccgagtgcgcgccgccgcggcccggctggcgggcggccgaaccatggcccgccgcttccggaccgaggacgtggtgaacgacgcgccgctgccgcagttcaagctggagctgggggccattgcgcagctgctggcgccgcggcggccgctcaagaggtccaagaagctggtgagaagcgggggcgggggcggggggtggtggtggtgctgggttgcttggtagaaggaagcttgagaaaggcgcgcaggggtagggcggagtagagttggggcggtggggaggggatggggccgcttcgcggcgcctggtctgcgggtgcccacgccctcttgtcacgtctcgagctatgcccagcaaccaaaatgccgtgcacctcttgcacgcctgttgcgaccctccacacgcctccacaccccaacatggctccgcaaatcatccttgtgcccccaggtcaagtcgctgatgacgtcggtgccgcgcgagacgcagctcatggtcaccatacagcgcgcagccagcctgcccgcgcgcatggccagatcggccgtgggcggcacagacgacaagcggctgcgacgcggcgcgggcgtggaccggcggagaggcgggcgggcgggcggcgacggcggcgacgagggcggaggcggtggcggcggcctgccgtcgggggcgccggaccggctgtcacagcagcgcaactgctttgtggaggtggggcggcagagtcatgatgagctgctaacgctcgtaagcgctgcgcccaaaacccgtccatcagagctcctcctcctccttctcccgcacctccaccttctcctcctaacccctttttgacgctccttctcccgactccctcgcctctgctcacccctgtttgttgcaggtgcgcttccgcagcctgtcgcagcgcaccatcgccgtgccgggcgagttccccatcttcaacgaggaggtggggcaggggagagcggcgggggcgcggggggggggattgttattaacagcccagactaacccagaaccaacgaaagcgagcggagcacaagcagaggtcttagttgcaagcgataatacttgtgggatgtgggccgaggcgtcgtggagcagcagggcgagcggcgccggcgataaatggggaatggggcagttgacggggtggcgatgcttagagcggtcgcccatgcttgcatgttggtgggctccaagtgggcgcggcccgcctctgtttggtcaggagtgggcacaggtgccgagtgccaacccctcccttctcgttcatcccttgggtgcacttcctgatgcggatggagcactccctccctgccctccctccctccctgccctccctctgccccttccctgctccccatgcctccccccgttgggctcgggcacacaccccctacccccctatcatgcattttaccccccaccccaaccttcagttctccttgccgcgcgactgtttccttacgggataggtccaacgtgaaccccccaccccaccccccaacacacacacacacacacacacagatcgacctggacgtgttccgggacgacggccgcgacacgcagcaggccggccccgaggacggctcggcgctggagccgtcccccagcgcgctgcaggagaactccgacctcatcaccttcaacgtgttcgatgagatcatcgtggagccctcagagccaattacgctgcgcaggaggtgggcggcgggggtgggcgggcaggcggcgatgggctcgagggggcgaggggcgattgccactcagccgctgtcacccgcatgccctgtcaccccacgctgttgccagcctcttggtgtgctgtccctaacctgtgctccctattatctgtgctgcccctcagtcggttccatgtttaaaacaagccagtcgcgtgaacggctacacctccctgcccccacctcgcacctcacccctccacgcagggacgcggagatcagcgacccggtgcgtctgccggagcgcgagcggcgcttcctgggctgcgtgcgggtgccgctgagcgccgtgtaccagatgcaggtgctggagggcaccttcaagctggaggcgccgccagtggtgctgggatacgtgcaggtgcgagggccgtggggggggggccggcctaggaagcagctggctggcagagatgtacgtgtgtgtcagagaacaaagggaatcaaagcacgccggaccgtgtgtgtgcgtgtttgtgtgggacggggtaacggaggtaacggcggaaggcgcctcgccgctgcaatctgccgtcgcagtcacttcaactccagcccctcgttctccccacgcctcctccccttctgcctgtgcccccacagaccagccagcggcccagcaccgtcagcatctacatgacgctgcggccgcggctggccgcccccgccggtgagatggacgagcgcatcacctcgggcgagcaagagcaggtcaaccggcacgcacaacggtggcgggcggcgctgctggggcgggccgagtgccgctcgcgagtcatcaaggtgtggcggcggggacagctgggaggaggggaagaggggagggcggagtcggtccagggagggatcctggcaacgctatatgacgggtggtgtggggggtaacttgctgatgcatgcgtgtgatttcatacacgtgcatctcatccgtgtccctgtccttcgcaacacggcgttcctcctctgcccatttccttgtggtcccaggtgatggctgtagacgcagacggcgcggcggtgctggtgtgccgctacgtggcgcccacactgctgccgccctcgctggccgtgaacgtggcggcgggcggcgcggcggtggcggcgggcggggtggagatgctcatgctcaagctggccagattcgtggcgcacgtgagtgccgtacgtgtgtatgcatgcgtaccgtatgcgtgtggtcgcgttgaggttgtcacggacacgtgcacccacacgcctcgcacacaacttggccatgccaggtactcccgtgttgcgctgcgtcacgctactccctgcctccccggatcgttgggctggggcaagtgcccgtgttccctcaccttcctagcccccgccctccttcagcctccttactagcctcctccacccccgcctccgcccccctcctgctatactaacgtccctggctacgccttcacttcttcaatgatgatgattgtaaacccgctcccctcccccgccccccaaccccaggtgccgtacatggaggacagcggcctgcacaagcggcgcaacgacatctggaccagcagcagcgagctgctgcacctggcgggcggcgacttcgaggagcacgcccacctgctggcgggctacttcctgcagctggggctgcaggtgggtgggcggctgcaaggagggctggggggggggggggtggaaggccgggcggaaggaggggtggagggaggggtgcagggaggggtggagggaggggcggagggaggggcggagggaggcgtggaggtgagatggcgcgcagggagcgaggtggcgtagggacggcggcagggtgggcgtgggggtggaaaggagtgccgaggcagccaccagcacgtcgtgcatgttacgacagcgcctcccccctccccgcctctcagcactcgccggctcccgtcagcgcccgctccgtcctgctcactcgcgcccgtcctgcctgtcccctccccctcccggcgccacacctgccaggcgttcgtggtggccggcacgtcgctgtgcggcgctcgcagcatgttcgtgctcaccaccggccaggccgccgcaccgccggggcagccgcaggcgccgccgccgcccctgcatctgaacgcggagctgctgcggctgtggaaccccatcaccggcagcgtggtgtcggtgaaggaccccaccggggaaatgcgcgaggtggggggagccggggcgcgggtattggtttgcactggggtggggtggctagttggccggcggttgcggccacggtgcatatgacggcaccttgtctgtagggcctctgtgtccttggctcatgcctgccccaccttcgcaactacggtagcgtatgcaacatattagaagaacccacctcgcccacgtacccgcacccccaggtgggccagctgtacgacggctccaacatctgggccaacacgcagcccacggggcggccgtgggagatgaactggaacctcaccagcggccgcgactgggtgcccttcttcggggcacagctgcccccgcgagagatcgccaccatacaggcgagactgcgacgctcatgcgctcgctgccgctatgcgtaatgccggaatgcactggcagggacaaggagcctaggcaagcactgcgcccgccgtgtcaaaacccgcacacgcacactatcccacagacaacgccgctgtacgaggagcttgagaagcagttctatgaggagctggaggggcgcgtggagaaaaaggtggaggaggccctcagccgtaagtcacggcgggcgtgggcgtggggggttgtaaattccagcccaaactaagggcgggggtggcgagcgtgtgaagtggaggaaatcaagatcatgtccgttcacacgtactgaatcccgccctcgcttgccctcccttgccctcccttgttctcacgcgcccacagaggctcgtgccgcgggcgccttcgtgaccaagcccgacaacagggtgtcccgactgctgaagaacctgctgagggagatgcccaaggtgcgtggcgcgcgggaggctgcacagcctggcctgcgcgatgcatggctgcgcggccgtgcttgcgttagcacgtgtggacttgtgcttggcgtggggtgttgacggcgcggcgtacacgcatgcgcgcgtcagcgagtctccgcgctcttgccaccgcccgacgcgccccaacactcgtcctcatgcctcacccgcggcccgcacctcccacagaccagcgaggccatcgcggccgcctctctggccgccagcgcggcgctggcggaggcggcgggcaaggggccgctggaggcgccgcagcacttgggcgagcgacacaacctcatcaccggcctgcaggtgggtggggcagttcttcccggagtaatccaagcatcaccaggaacccagcaacccccccccccaattaatcatgaatgtaaccccccagtccgatccagcccggcctatagagcacagaggaggtagggcgctgttgcacgcggagttggccgggtcgtgggcggcatggcttcgcctgatacgccacatgggaatgatatgcaccgcagccgcccgggcctcgcgctcctcggccctggccacgagtccgtagcagcacgcacgctcacacacgacagttcttcgcttccctgaacacccgcgctatcttccattccgagccgccactgctgctgcgccgcgtcgccggtgccggcctggcccctgctgctcctgctcccgcaggccagccacaacgagcgcatccggcgcgagtccaaggccgaggcggtacacggccacgtgcttgcgctgcccttcagcgactcctacctggaggcggtggcggacgcagtactcaacacgggtgcgcgaggggcggggtgggggttggggctgtaaagaccagcccaaaccaaaccaagccaagccaagtggggggaggttagccgtctgtgaacgactttggtatgaaatcgcatgggcgtatacggtatgcccaagcccaaggataagggggcagggcagcggatcgggcggggcggtaggcggcggacgctgtgcgttgaggggacggtggggagccaagggggacaagtgaaattgaggctgggccgcgctgcacagggagttggctggaggtagcggcgccgagagagtcgcaaggatgtatgactgcacgagcaagcaggggtgctgcatgcctgtggatttcggtcgtgcggcgctacctagctagcttcctcgctcactcaagcatctgtttccctccgtatgctgaccgccgcggcgccgcatgatggcctgcaggcatccaccggattgcggacgagcgggtgaagttcagcaccgccgtgttcgtggagccgctgggcgcgtccttcgtgtgctgcgtctggatctatgtggcggcgattcgctcgtga

SEQ ID NO: 19 - DNA, 4804 bp, Chlamydomonas reinhardtii
atgagctacgggggcacggaggtgcgagtgctagctgaccagcgcattttcggcttccactgcaccggaagggagcctaaaacgctgcatgtcccaccgcaggaggatgacctttatggaggatatgatgagcaatcgaacccgcttgcggtgagctgcttgtggtcacgctatgttatgcgcatgtgtgcaccggtccttaccttgcgcgaccgcgttttgcagggctcgggtggtgccgcatttaaggcacttggggccgatggagctcctccaggcaccggtgggtatcagggcctcgcggttgccgcagcggtcacagcggttgcttccttggttgcttcgctggggcaagtgggcacggcctcactgcttcgggctgctgatccggaaccttctcccacacgctgcagccatgatggggccgcctggcacggccatgaagagcttcgtgccaggcacggctatgcggggcggcacggcgatgcagcaggaccccagcctggcgcggcctatgacctcgaaccggggtgctggcttcacgtcggcgcctaacaagaagtttgaccccctcaatcgctcaatggggtcgacactgggctcgtcggggggtggcgcaatgctggtggctcgcaagggtgacaccagcccggaggagcaggcgcgcgggatggagaagacggtgcatgagctgcttgagaagagcgcggcggacgcggctaagaatgacatcaactcgggtgaggcgattggcagctgtccaggcgttgcagggcgttgggccgtgtggacgggcagccaaatgagatgggtgtgtgctgcggtgctgggcgcgaccagcatacaaagaggagtgctgctgcggaacacgtacggccgcagcccgtggtttggcaaaaccagacgacagccctggtgcgatcagcggctacggcaggcacgcggtatcggcagtgcattgccgctccgtacggccacgtatccaagcgtttgcggcgcggcattcggaccaaattgttgcgcatttgcacccctaggcaaagcagcggcacgacttgttgtggcggaaggtgcacatgcggagatggcgatgagtcggcacctggtggcggcgcacttagtgttacggtactcttcaaccagaaaggtctgacctggatccgccggcctgtctgttgcatctcgcccaaccccccgcagccctggagaacgccatggaggcgaagaagaatgagcgaaagctgtgccgcttccgggaacagaacaacatggcggaccaggtgcgtgtgcagccatctagtgcactgcatggctttacgctctgcggcaaccgagtcctgcgcgctgcagcgcagacacttgagattgctgtgcgcgctgcccggctgcatgcaccttaggcaagcccacgcacccttaactctgcccgtgccgcctgcaaccgcaaccttatttaacctctttgatttcgcttctcaaccacacagatcaacctggagctgatgtacgccgtggacttcaacctggcacacatgtaccacatgaacaagaactacagcgaggcgctgaacctgtacacaggtacgtttggtgcgtgtggggcgccgtgagggtggcggcgccgggcgcaagaatggatatctgctgggtctctgtccacatgcccacacgcttgctgatggccccacctctcaacctgcaacccctgcgcagccatcgtgcgcaacaagaacttcccgcagtcgggttggctgcgcgtcaacatgggcaacatccacttcgagcagaagaagtacccctccgccatcaagatgtaccgcatggcgttggaccagatcagcgccaccgccaaggaggtccgcttcaagatcatgcgcaacatcgggctgtcgttcgtgcgcatgggccagtaccccgacgcgctgcagtccttcgccacggtcatggacaacgtgcccgaccaccagaccggctacaacctggtcatgtgcaactacgcgctgagcgaccgcgagggcatgaagaacgccttcatcaagctgctcaaggtgcgtgcgtttgcatgtgtgtttgcgtttgccttggcggttggggcggaatgggcgcggtttgagtgcggatgcaaggctcacgtgcacgtatgtcacatacggtatgtgtgcctacgtcgcacgagtcacgcatggccacgcgcacctgccgccgtgtgttgattcgtgttgtgcgacacgcggcgcaggtgagcccacccagcgagatggatgacgatgacgacgacgaccccatgggcgatgacgacatgcaagtgatgaccatggatgacgggctgaaggacgagatgcgcaagcgcaacaccatcatcacgcgcctcattgtcaaggccgcgcagctcatctccgagaaggtaggagggttgcagcacggtaaatcacacagcgaggctatgcgggctgtgtaccttgagtgcacgtgagcttgcggctgccggcacagtatgccctctcattcctctcatccccgaggcctcctgccgccgcttcacaggtggatcgcgccaacggctttgagggcggcttcatgtggtgctgcgagcagctgcgcgacgcgggctacaccaagctggccaacgaggtggagctggccaaggcgacccggttcatggggcaaaagcagtttgacaaagccgtgggcgtgttcaaggtgagggagggagggagggagggagggagggagggagggagggagggagggagggagggagggagggaggaagggagggagggagggagggagggagggagggagggagggagggagggagggagggagggagggagggacgtcgtgaggcaaggtggaagcaatagggggtcgcacctgcagcacacttcagcgattgagaacagatagtgtcatggatatgtggcctcatggccgcattgcacacgactgtgccacccgtctcgccccttccccaccagccgtgcccttccctaatcaccacccgcccgcctcgcctcgcctcaccccacaggactttgagaagaaggagccgcgcgtcaaggcgcgcgccgccaccaacctggcgttcctgtacttcctggagggcgagaccgaccaggccgacaagtacagcgagatggcgctcaagagcgaccgctacaacgcacgagcctacgtcaacaagggatgcgtgctggtggagcgcggcgatctggagggagcgcgaagcctgttcaacgaggtgaggactgaggaaggcctaagccgggctgtcactaaccgggtggaggcttgacatgagctgctgaccagtgcactgccttactacgtcaagtgtcggcccagagctgatgcaaccgctgcattgtttcactcgctcgattatcacttcagtcactgactccctcaatcgcacacacgtcatgtgtttcaggctgccggcatcgacccctactgcgtggaggccatctacaacctgggcctggtgagccagcgcctgaacgagctgccgtacgcgctggcggcgttcaagaagctgcacaacatggtgcccgacaacgtggaggtcatccaccaggtgcgtgcagcattcggccgctggggcgcttgaaggcgcactcctgggcagtgcgcgcgctgcaccacccgcatcaactctatcctcttgcatgcagcaccctaccccggcggcactgacgcgctgtaaccctgcctgcccccgcaaaccgcgtgtcgccccgcagatcgccaccacgtacgacatgatgggcgacttcaagaacgcggtcaagtggtttgagctgctcacctcgctggtcagcaacgaccccggcgtgctggcgcgactgggagccatccacgccaggtgggtcacggccaggcatcgccgcggggacggggccactggccggtgccagcctacatgctggcgtgcatgctggcgcgccaaccgcacactggcaaaagcagcgcataccgtacgtgcgcgccgagtgccggcgcctctccgcctccttttcacctcgctttcggcctcctctgtcctcgccacttcctccacgcaccgccgcgcaggttcgacgacgaggccaaggcgctgcactactaccaggagtcgcaccgcgtgtacccggtgaacatggacgtcatctcctggctgggcgcctaccatgtcaaatcggaggtgtacgagaaggccatgcccttctttgacctggcctccaagatccagccgcaggaggtcaagtgggcgctcatggtggcgtcctgctaccgccgcaccaacaacctgcccgccgcgctgggcaagtacaagcaaatccacacgcagcaccccgacaacgttgagtgcctgcgctacctggtgcacctgtgctccgagctgggccgccgcgccgaggccgccgagtacatgaccaagctcaaaaaggcggagaaggtgcgcggggcggtggaggcagaggatggcggggggttgcgggttggagccttgcaggccttgggctgttgcgcccgctgcggttactcctgtactcgtgcttacttgttgctgctccacgtgtttcgatctccccaggcggcggtgcccgaggcaacgacagcggcggcgcccgccgcggccgcagctggcagtggcatgggtggcatgggcggcctggacgacgacattggcagcagcgcggtgtcggcgcagaaccgcggcaagaagatgctggtcaaagagcacatgggtggcggcggtggcaaggacaacgacgactggggaaacgagcagcttggggacgacctgctgcccatgtaa

SEQ ID NO: 20 - DNA, 20404 bp, Chlamydomonas reinhardtii
atgagggtgaatgccggcgacggcagagctgccgccccgatcccggagaaaacggtgctcttgaagggcccactccaggaccgggtgatagcatggtcgctcgacgccatcgaaaacggcgaggcatggcaaaaacaggttagttaatgggtccaggcaggggcttgcgaacggatgctgacatgaccggcggcgaagcacatcggccccgcgcgcgatgccatgcatgccacgaagccttgcctcgttgcttgacccccgcccgaccgccggccccgcctcgcagctccagccgctccccgacacctttgagacggcggaggagtgggccggcctgctgcagccctttttgctgctggagatgcaggcggggctgcggcaggcgctggagcagctgggctccgccaagtggctgccgctggacggcgtgccggagctgcgacgagataacgaccaacgcggcggcggcggcggtttgattggcggcgaggaagatggcttgggcggcttcgcgccgccgactttatgcaaggccactgtcaacttcaccgtgcgcgggcaggaccgaagcggcgccggagcaggcgactggcgcgccgcgcgtgccgccaccgcggcggcggcggcttcacaagcgggaggtggcggctgggtgcacaagaagccgccgccactcaagcccactgacatcgtattgctggtcaacgcccgggtgagtgacgagttcattgggcggcggtagctagctaggtggaaggttcccatccagtacatgtctgttgacacggcgttgcctggcttagtcataacgagcgcatgcatggagctactacacacagctaataacgaacacaccgccgcgcgccttgccctacttccgtgtgttatcctggtttcctcatgtgtcaggtaccggacctggcttcgctccggcgcagcgacgtgctgtgggtgctgggcgtggtgcagcggtcgcaacgcggcatcgtgggggacgccgaggacgaggaggacggaggcggcggtttcttccgcgcggcggtgcatgtggccgcgggcagcagactggaggcggcactgggtgagtcacggcagcttactgctactgctgcgtgtgtgttttatgtgtgctcacacagttgacgtgtgagcacacataaagcgcgggagccggtagcacgcacagcagccatacatagcataccatgccgccccgtcctgctgccatcctgcggcctgccgtcgccgcccctgccgtcgcccctgccactgccgctgtccctgccaatacctgttgttgtgtttgtgctgtcgcagccggcggaggcgccgccgcgtctggcggcggcttggcggctgcggcgcgggagtggtacgcggtgccggtgggcagcatcgccacagacgagcgcgtgtggaatgcgcttctcttcctgggcccgctcccggtggcaggcagcggcactgccctgtcgcgtctgttgccgccaccgccgcagccatgcatgctgcagctactgctcggcgacggcaggagcagcagtagcagcagcgccggcgctggcttcggtggaggcagtagcactgtctacgtggaatccatccgtgccgctgctcggcactacgcgagcaccgtgcggcggctcaatccctcgcagcaggacgcggtcgtgcgtgcggctgtggccttggcggcccgttccccagccaatgccattgccaatgttgaagacgcaggcagcggcagtggcagtagcagctgcggcagtagcggcggcggcggcggccgcgcggagctgcagctggtgcagggtccgccgggcacgggcaagacctccaccacggccgcgcagctgtcggttctggcggcagtggggaggccgggcactgcgctgctggcaactgcgcccaccaacgccgccgtgggcgagacagcctccaggtgcgtgtgcgtgtgtgcgtgcgtgtgcgtgcatgcgtgcgtgtgtgtgtgcgtgtgcttgccgctgagtgtgcgtatgcggattgtgacatgtgccatgtgggatgtcgcctccgcctctcgccccttcctgctgaccgtggcaactccgcatcgttacatatctgcatgcacatacgcatgcgcaaccttgcaggtttgtgaagctggtggcggcgggcggtcagcagtttgcggacagcgaggctgcggcggagctgcgccgccacggtctgcgcgtggagccgccgctcctacccggtgcgtgtgtgcagcgcgtgggcatgggcatcggggtgcgtgtggggggcaagcgggcggggcacatggctggatgctctgtctacctgcacgcaacctgtacgtgcacctctatctccaccctccctcgaaccaattcaatatcgccttcactacatgcggtagcctgtccagcagacggttagctacctgcggctgtccaaccgaaagataacacacattgtaaaacaacgcgccacaggcgacatcgtgctactgggctcgggcgaccgactggacctgaccggcagccccgagctgctggccgtgttcctgcaggccaggtggggtgtggagggatgtggaggggtgtggagggggcaggtggggtgtggaggggtgtggaggggtcaggtggggcgtggagggtgtgtggaggtgtgtggaggtgtgtggagggggcaggtggggttcctgcaggccatgtgggggtggatagggtgtggagggggcaggtgggggtgcctactgctgtactttttggtggaggatgtccctgctgaaggccgcgctgtggtatagctggatgagggcgtgcgagggcagatagattggtgggtggtgatggccgtggatggtcgggctgatggagcactttggcagacagggagcacgggtgcatgtgtgcggttgtctggcgctcatcactaccactcatgccactccataaactacagccaacacaccatgcagatcgcgccgtcacctgtccacccggacccacccatccacacagggccaagcggctgtctgcggcgctggccacctggtccctgacggtactcgacatgcggcggctgctcgcctacccctgccaggtgcatgtggacacattgcgcgcggcggaggcagccaccgccgccgccgccgcaccgggtgcattccgacagccgccgccgccaccgcagccgccgccgccccgaagcgtgggagggtttctcaagcagcggctgccgccgctgctgcgcgagctggcggccgcggccagatgcctactcgcagacctgccgtctgcggcctgggtggcgggcagcagcagcaacaacaacaacaatagcaggggcaacagcactgggatcgccgctgtcggtgggcgtggcgccgccaatggtagcttggcgccggcggccgcatatgccgcgcgagccgacaccatcgtggcgaatcgcgacgcggtgcagggcctggtagacgcgtgcgcccatctggcagcggggctggcggcggcgagcgctgcggaggcgtcacgtgcggctgaggaggtggagcggcgtggcggcgccgctagcggcgccgacacagatgccggcgggcccctcctatcgggctccgccgccctggcgtcctccatgctcgacctgacagccgccatggaacgtgcacgccgcgcactcgcgtcgaatgtgcccatgcccaacgcggcgcgctcgggcggcgggaacatcttcgggtaagtacgtgtgtaccacctcctcatcgtgagatatgcacgcatggcgcaggtatgcagaaacgaggccgcagctactaacgaagccagtggcgcgcacactgtttggcaccagccgcgcaagttcaaagcgcggcccatgcacgccttgccgtatgtaggccttcaaattgtgcacacgggcctagctagcatccgcggcctcttcccatgttgtaaagcaacggccacgctctcctcctcgctctactgcattgggttcggtttagtttgggctggtatctacgacccacccacgcaatcgccaagcaggtactgcctctcaaaggcacgcgccatcttcgccacggtggcggcggtggggtcggcgcgcatggccgccgccccgcccgtggaggcggcggtggtggatgaggccgcccagctgccggaggcgcacctggctgtgccgctggcgctgtgtggcggcgggtcgctggcgctgctggtgctggtgggcgacccccagcagctgcccgccacagtgctgtcgcaggtgagcgctttgttggttgggtggttggttggttggttggttgtgcggggcgtggtgcaagcgcgggacgacgtgtgagacgatgggacgacgggacgacgtgtgatagacgatgggacgatgggacgacgggacgacgtgtgatagacgatgggacgatgggacgacgcgtgagacgatgcaaatccgccggctacttaggtaagacgagatagcatccagctagacggcgtgtaccgacctggaccgaccgcacccttatgctcctgatcttcgctgatgccgctgctgcgccctgcctgcctgcctgcctgcccgcctacccacctcgcaggtggctcaggccaggttgtacggccgcagcgcctttgagcgcctgcagcggtgccaaggctggcccgcggtgagtcaatgaatgcatgtctggatgggttgacagcgctgggcgcacatgcggcgcttgtgggagtgtcaagaccagaattccaactgttgacattcagccatacgggcatcgttagcgctaaggatgcccgtatggctgaatgtcaacacccactgctgcttttcttgtacctgctgctcttcacacgactccacgctgctgatgtctgcatggcctatctacacacgcacccagcctgtcgatctacacccagcctgtcgatctagacccaaccgcacctgcacctgcacacacctgcacccacacctgcacccacacctgcacccacacctgctctccccacctgcacccgcgcacacgcagctgctgctggacacgcagtaccgcatgcacccggccatcagcacctggccgcgggaccgcttctacggcggcagggtgagtgggcgcgcctcggtttttagccggatgctgctttagcaacccattatctcatcatcccaacgatgcaaacatgtgcgtgatgtgcgcgatgcaggtggtggacgggcccaacgtgaccgcccccgcgtacgccggcgtggcgcagctgctggggctggcctgggggcccctggtggtgctggacgtgagcagtggggcggaggagcgggaggcctacaatgacggcactggcgaggaggacgccggcggcggtggtggcggcggcggcggcggcggcaaaggcaccagctggcgcaacccgcacgaggccgcggtggcggcggcggtggtgcggcaggtggcggcagcgtggcgagcgctgcgcagcaacagcaataccgtgagtatgaccggtgctggcgccgcgaccaatggtgctggtggtgtcgcggccgctgcgacggcggaggccctggcgggcctgacggcggcgcgccggtcgctctccatcggcgtcatttcgccgtacaggtgggcggctagggctggcctagaaacgatctaagaagacgagcaacaggggatggtgagtcattcgtttcatgccttcacacgtcgccgcgcccacccattcctgctgcacacacacacacacacacacacacacacacacacacacacacacacacacacacacacacagggcccaggtggacctcatcacctccaagctggagcgactggacatcgaccttgcgttgcaggcggatgcggaggcagaggcacaggcggcggcagaggcgggaggggcggaggcgggcacaggcgggccgccagccgcgccatcaggtggtggcggcgtgtcggtcgcggtgcgctccgtggacgggttccaggtgcgtgtgcgcgtgtgcgcgtgggtgcgtgtgcgcgtgggtgcgtgtgcgcgtgggtgcgtgtgcgcgtgggtgcgtgtgtgcgcgtgaagtactgcaggacttgcacgccgccgcggctgcccgttccctccatgcgctcatgtgctcacttagctggccgcggtgtttgcccccctctgctcgctgcttcaatccgctccacaccatcttctgcatcgacccttcctgtgacacgctgccggctgagcccgtcattgggtcttccatgctgctccacctcaccccagtccaccttcacctcctcacctcttttgtttctgctccacccaccccaccccgccactgctccaccgccattaccaacacaacccaacagggccaggagaaggacgtgatcgtgctgagcctggtgcgcgccaacaccgccggctatgtgggcttcacggacgacgcacgccgcctcaacgtggccgccacacgcgcccgccacggcctggtggtgctggtgcacgccgccacactgcgccaccgcagcgaggtgcgagtagcgcgagtagcgcgtgggctcctgggggacgtgcattgagactgagggtgcgggaggaagagtgggcaggtagacacacacacacacacacacacacacacacacacacacacacacacacacacacacaggcacacacacacaggcacacacatgctacctttttataacacatgctacctatgtggataggtcactttttccgtttcgtcgtccaacacatcttgtgcttgcgtgcagctgctgcgtgcgttcctggaagatgcaaggcagcgcggcgtgctgctgtctgccagcgaccagccgcagatggcgcccgcgttccgggctgtgcaggcggagcagcggcggtgcgccgctatcgtgcgcggcagggcgccgtgggacgaagcgccatggaaggtgcgcatgcatgctaggcccccgtgcccagccgcgccgtgccagcagtctgctggtccttcctgcccatctggctagccccttctatcccgtcgtgccacgcacctgcatgccggcggcacatcaccaatccgcacacaaccgcacaccgtgcccgcacgcaggtgatctacacggaccgctactgcagctcctgcatgcagctgcagcccaaggcgtggcgcgtgcgcatgatcgatgcggtgagcgataccgtacgtagatgagttggatcgagacattggaacgtaagagcgagcgagacggcatgcatgcatgcgaaattaccatacccgatgtgcccacgtgtctgcaagcggaaaccagtgtgtatcggcatatcgctgccgccgcgcaccgccgcgccgtttgaatggttgattgcaagcaccgaccccaccgaccccaccgctggttgccaacgccgccgcccctactcctacccatttatcccatacggtactgcccactcgtcgtaggtgctggagctggcgcacgggcgcttcccgcggcggcaggtgccgctggcggcggtgcggcccgagttggccgccctgctgcgcggccaacggctgcagggcgggcggctggtgctgctgtggtcggtgcggctggagaggcatcagcagcagcccgtgcgccagggcggcagatgggtgcaagcgctgcaggtgcgtatgtcgttgcatgcagttgcatggtgaaaagccaaccagcagccatgaacttaacggccgtgtctcttgtgcgcgcgtggcggcgggtacggttggcggtgctgtgagtgatgctagcgaggtgtgcgcgtctgctaccgttctcttctcacagttgcctcgtcccttccttcttactcccaccgcagctgtgggacgtgctacggctgctgcccgggcaggatgcggagctgggtgcggcggtacgacgggtggaggccgagatggccacctacacagacgaacacctggctgcgttgcggtacgtgggcgcagacgtgtttacgtggctggacggatggggtgttgcatgggataccagcaagcaaccatggggcgatgcatgggttagtagctaagcatgcgcagcctttgcagaaaggtgtgcagcggcacctgaatgctggcctggctagcagtcaagtagcaacctcgctcaagccactagatcgctccatttcacagtcgggctcgctccatttcacaacacccacccgccgtacacctgccgtacatgcacgcacctgcaggctgggcgagccggggcccgacggcctcatccggccgcgcctgatctgcaccgggcccgacctgccctttgcccgcttcgttggggccgcagcagccgcccctggcggggccgccacctctgggacagcagcagcggggcgccacgccggcgtggggccccggggtgcagcagccgcgggcgctggcgacgatgctgacagtgccggtgtggacgcgcagcaggagcagcaagggccggacacgcacagccggctgtacgtgatggatgcgctgcacgcgcggcagctcgccaccagcgaccaggcgggcgcgctggcggcgatgttcaaggttcgcgtttgcgtttgcgttgcgagctgtgaggagtaagggcagcagccgctcggttgcttgggtgtgcgtgcaagtagttgatagcagataggcgcgcgtgcgttgtgctgagtacagagctcacttgctccggtccgcgattgcccgcactcattctgcatgccgggtgccgccctgcagctgacgccggagcaggagcgggtggtgcacgacgaccgctccgtcattgtcatcgggcgcagcggcacgggcaaggcaggtggcaacgcgaccaggggcaccggggcaagcaggggcgtggtgcggcttgtatgcctcggagcgcagacgcacgcacttgcatgacgcgcgcgaggcagacacccgcccttcactgttcacaaggggatgcgaacaccgcgcgcaggggcccccctgccttacctgatgcttgctttcacacctgtgcccccacacgctccacacgcaacacagaccagtgtcatcctgtcgcgggtgctgctttacgaggaggccttcgcgcggctgcacggcggcggtggacgtgatgaggcggagggtgggcagcagcagggcagcagtggcagcagcggcagcagcgcggccgcggccgccggcagcaaggtgcggcagttgatcgtgacgctgagcccccgcctcgcgagctccactgccacctacctgcgcaagtgcacggcccagttccagggcctgcagctggccgcgacagcagccgaagcgctcgatgattcggcagacgctggaggcggcggagcagatgccggcggcgggggcgaggctggcggcgggggcgaggctggcggcgggggcctgctgcagcttagtgacgacacggacgcggcacgcatgtacggcgacatgcccggcagcctggcggaggtgtcggacgccgcctgcccgctggtgctggacctgcgccgcttcctcctcatgctggacgccgggctgcctgacccattcgcggcggcacagcggcgtcgggcggcggcggcggcggcccggcgtcgggcggcaacggcaggtgctggcggtggcagcagggccgcgccggcgccggctcagcaggcgaaggcgccggcggcgcggggtagcgggcagcggtcgcacgaggatgatgatgacgaggacgttcctgacacctgggacgttgacagcgaggacggcgctgttgggctcggtgccgcgggcggcggtctgggtgcggccgtaggtcagcagcagtgcgaggcggcggcggaggcggtggaggtggactatgagcgctttgcggcggcgtactggccgcgattcagtgccgagctgcgcaagggcttcaagtgagtgtgcacttgaaatgaatgcacttgatgatgacagcttgctctgtcaactcgtttcctgtcaagcaccgcatgctgcttgcgcgcaagtgcgggcaaacgcaggccaggccacactgcgtgccaacgaccggaggtttacggccgaagacgtacgacaggagatggcttgattgctgcttggcgatgtgtttgcgctctgccgctgccgccgcagagagccggctctggtgtggcgcgaggtgcagacgcacatcaagggcagcctggctgcggtgctgccggaggcctggggcggcggcggcggccggctgtcgcaggaggcgtatgtgggcatggcggattcacgcgccggcgcgaacctaagcgccgagcagcgcgagtgcatctacaaactgttcaagtgagtacggctgtcaaggaggctgttcaagcgcggcgcctaacctagctgattcttctgctcttgtgcgctttgcgcatcaagcgtcatcaatgccatgataatccacgtacggcggtgtttgctccaaatgcagcttgagggcgcggcagccgcagacctaccttcaaacctcaaactgctaccacatgcttttacacgtgcatacggccggccgttcacatggacaggcagtatgagcggcagaaggaggcgcagggcgagtttgacctgggcgacctcaccgcacacctgcacacggcgcttggcggcggcggcagcaggcgtgcccaggcggcggcggcgctggcggcggcccggcaattccgatttgtgtacgtggacgaggttcaggacctcacgccggcccaggtggcactgttcaagtgggtacggttcacctcagcctcttgcttgctttgggcgctgtggccacgcgttgtggctgtgctgttcccgccatcaaccattatggtgtgtcgcccacccgcccgccccacgcccaacgctccacgcacctgcatacatctcaacacctgtatgcccatgcccatgctccacgcacctgcacgcatcttaatatatatatcggtatgcccatgcccatgcccacgcgacgcaggtacgtgtgcgcccgccccgccgacgggctgctgctggcaggcgacacggcgcagaccatcgccaagggcgtggcgttcaggttcgaggcgctgaaggacctattctacctgtggatgctgaggggcggccctggcgggcaggggccgcccgcgccgctgttcgggccgggacggccggtggccccgctgccgctgggcgtcaaggtgcccgaggtaggtgcgtgtgcgtcctaggtaggcatccaccctctgcgccgctcccgccctcacctttctcctgcaccagacctatcgcaaccactcgtgcacccggcactcaggtgacgccgctgctggagaacttccgcacgcacgccgccatctcgcgactggcgcacttcggcgtgctggagccgctgctggccttgttccccgaggcgctggaccgactgccgccagagacctccaagctccggggtaggcaggggaaaggggcagggacaggacagggacagggacaggggcagggcagggcagggcagggtgcatgcttggtgaacacggctggctgccctacttaccaccttggatcgcccgccttggaccccggcggcgccacacaggcccgaagcctctgttcctgctgccctcctgcggccggctggaggacctgctcctgccagacactgctgctgggggcagtggcccggccgccgccgccgctgcccgttcgggcgggggcgccaatggtgggggtggcggagaccgcggctcgaccgcagccgcagcggcggcggcggctcacgaggtggtggtgctggtgccgaccgaggcggccaagcaggcggtgcgccggcagctggggtgcggcgacggcggtgcagggcagcaggtgctggtgctaacggcactggagagcaagggcctcgagttcaaggtgcgtgcaggaggtgtcgtacatagttcatgtgggcgcatgcgttcaagcctccctgcttgcctgcgtgtgaccccacggcgcacggccctgacttgtagctccacaggaggccgtggacttacttgggtggcctgaacgcatgtggccggcgcgctcattcaccgcacgtaacctgtcgcatgttcggagcccgcccacccattgcctccacccccaaacccacggcctcaacccccctgtgccccgctcgttttcgttggttttggtttagtttgggctggtatttacaaccccacccccacggcctcttatctgcccgcaggttgtgctgctgtacaacttcttcagctgctcggctctgcagcccgcctcacgatggcggctgctctaccgcctgctggtgcagcccgagttcggcggccggctgcgacccgagcaagtggagccgggaggggagttcgcggcgcccagcttcgacctgcgggtgcgctagctatgtacatgcgtgcttccgtcctggcagcccgctgattgctgtgtgtgttacttgtgtgtgtgtcggggcagctcggcgggcagctgttatggcgcaagagcgtgactcggaccgcgccgccgcccctgcaagcgccgcacatcgcacaacatgcgcttccggcttgcgacggctaataattcgcccctctgtgcgcacgcgttttcgcgcaggttcacagcgtgttggcctcggtgctcaaggaggcgtacgtggctgtgacgcgcgcgcggctggatgtggcgattctggaggaggaccccgcagcggcggagcccgtgcgcgcgctgtggggaaagcaggggatggatctggtggacgagcgagcgcaggcggacgacgcggtaagatacaaaagcaggcacatcgtgcaggcacatgcaaggaagccatcgcgcgggcacacaatgatcttactaagacatcccgatcgcaggcacagtgccgacccttccccttctgcttcatatcctatcacatgcacgggattgtatgcaggtactggtccggctgcggcggcagatggagccggaggagttgcggcagcgcgcggcggacctgttcggggtgggcaactaccgcgacgcatcggcgctgtttggtcgcctgggtgagcgagcccagccttatccggcgtgcttgcttctttgcgatgcgtgcttgcgtgcgtggatgggtcgtgtgagcacgtcaccgtcctacagatgcattcgcacacctgccgacgcgcccctggccccaccatcacataacacacaggcgacacggcaaacaagctgttctgtgatgcccagctggtcaaacaagacgccgtgcgcgctcacaacgaaggcagagccaaggctgcagagcggctgcacgcgaccgcggcgcagctcttcatgcagtgcggtgagaactggtaacttgcttgcaggcccgtgtcgcaattctcgtgcagtagcgctgtcgcattgcttgtgccaagtctgtgcgtacgttgcaacctgtcaactggtatttatccatgtggttgcatgaatggacgcgtcgtgaacacgtggcgcgaccggagacgcattctgtcatgtgttgatgcttatttgacgtaacgcagggaggtacgcccaggcggcggagcagttcggggcggcgggactgtggggcgaggcgggagacgtgtaccacacccacctgcgggacagcctccaggccgccacctgctacgagcgcgcgggtcgctgggcggacgcggctcgccggtacgtcgcccccacacgcgcatgcacgagtgcgtgtgtgcagggtccgtgggtgtgtcagggagatgatgactgggtgccggcgtgtaggcgtagctgcaatcctgctgaggacgctctatcgcgcctgtcaagctcaccagtgcgtgcatcgttgtatgccacgcgcgtgtacaggcttgtggaggtggcgcccacgggcccggcaggaggaggagatggtggcggcgggccggcgcacctggaccgcaccctggccgcctgcgtcgcagccaaggagttcatgctgggggtggaagccttgcagcgctggagccagcaacccaacctcctgctgccgccgcagcagccgcagcagcaaccgcggccggcagcggcaggggccgccgccgcggctgtggcgcggcgcgcacagctgctgctgccacggctggtgtcgcggggcgcgctgcactggagggacgtggcgggcgggcgcgatgagatgcttcgcttcgtgcagctgctgccgggtggcgagacggcgcagcgccgctggctggaaaggtgcgggccaggggcggggcgcggacgattagatggatggatgctggaccctcgttggcttgctgtggatgggtgggcgggcgggtgtgttgaaagaaagtttattgtcggcacaatcgcacacacgcgcacacgctttcatgcaggtatcggctgtttgacgagatcctgcggctggacgtcgccgccggccgcttcctgtctgccgctcgcatcatggaggcacaggcggcggcagtgccggcaaccggcggcggtggcgcggtggcggcggaggcgctggggcacgcggtggagctcttcgtcagggccggccgggcggaggaggcggtggcgctgctgctgcgccgcgcgcgcagcgctgtactgtggggcggcgagcggtcggactggccgccgcccaagcggcccggcggcggcggtggaggtggaggcgcagcagcacggcacctggagcaggcgctgcaggtgctgcagcaggacaacgcggggggcaagatggggccggtggccagacgggcctgccagctgcaggcggacgtgctgagcctgctggtcaagtcgggaggtggaggcggaggcagcagcagcggcgagagggcggcggcggtgcacaacaaagccgccgctgctggcgtgcccctgcaggcgacgacaacgctgttggagcagtgggaggactggcgaccgcgtatcggtgcgctcgaggcaagcgcaggcggcagcggctgtggcggcgcagcggcgctggcgcggctgtgcctgctgcggcgcctgtgttatgaagccgtggaacaggcggcggcggtaacggcgcagcagcagaagcagcagcaggcgcagaagcagcttccctccatcaacagtgctggcaggccagcggcggccgccgccgccgccgccgccgccgccgccgccgccgccgccgccgccgccgaggcgaccaccgcctccattgccgccgccgcggtgcagctgctccgcctgtggggcctgtaccgacgctctctgacagacgtgctgcgtgtgctggagcgggcgcagcagggagttgtcgcagcggccgtagcgcccggtggcggcggcggcgccgctgctgccaggtccgccgctgtcgggtccgcggcttcctcggctgcggctcaggaggcggagctgctggcggcgctgcgggcataccacctggtcgtgcccggaggcgcacacgccgccggtgccgaggcggcggtgtctgccggcggcggagcgggcggcagtggcgccggcgggagcggcgagctgcggctcgagtgctcgcacagcgcggcctgggtgcgcccgccggcggtgcgcgcggcgctgcgcaaggtcctgatctccaggtgcagcctcggcggcggcgtatccaatgctgccgacgccgcggcgccggctgctgctgctgccggcggcggcgacggagcggcaaccgtgacccagcttgtgctcacggaagtgtcgcctgacacgttctacgccggcgcctcgctctactggcgagcggagctggaggcgcggtcggcggcggcgctgagggcgctgctcggcatggcggaggccctgcggcccagctatgagacctacaaggccgtgggggacacggcgctgacaggcggccggcccaacgcgctcgtgatacggacgccggcggcagcggcaggaagaggaggaggaggaggagccggcggcgcggcagcggcggcggatgccactcagttgcgggcgcagctgctggcggtggtggtggccgaggcacggctgctgcaacaggcgtgtgtgtgtgtgtgtgtgtgtgtgtgtgtgtgcgtgtgtgtgtgtgtgtgcgtgtgtgtgcgtgcgtgtgtgtgcgtgcgtgtgtgtgcgtgtgtgcgtgtgtgcgtgtgtgcgtgtgtgcgtgtgtgcgtgtgtgcgtgtgtgcgtgtgtgcgtgtgtgtgtatgtgtgcgtgtgtgcgtgtgtgtgtgcgtgtgtgtgtgtgtgtgtgtgtgtgtgtgtgtctgtgtgtgtgcgtgtgtgtgtggcactgcgtgcgtgcgtgtttgggagtgcatgtgaatggggcccttaacgtgctctctccggtaaatggctgtcatcgtgacatgtgcaacatacactccccaacctgctctgcagcttcagagcaaggcttccgaccgcggcggcagcaacaaaggcgccgctagcggcagggtcgcggcagccaacgcggcagccaacgcagcagccggtcgcccacctgctggtctggcagtagcagcagcagtagcagctgctgccgacctggacgccctgctggagcagctgctggccgccaccgtcacggcgccgctgccggcactgctgcgcgctgccagcctgccggcggcgcggcgccacgcgctggaggagctggaggcgcactacctgccgcgcctgctggcggcggcggcggcacggcagccgcggctggtgctgccgctggtgcaccgggcgcaggacctgctgtgggagcggcccgcgcccagccgcctgacactggaagaggtggccagggtggtgctgttgcaggtgggtgggcccgtggccggctaggcctgcattgcgcgtgccgcggacggaaggactggctggctggcatacgtcgccaccttcagctagccgtctgtatgcgtctaccgtgcctacgctgctctacgctgtatctgcttatccatctgctacttaccgtatctgtgccacctcacgtctgctccttgaacttgtgcgtgtctctgtgtgctgtaactacacatcgtgtgtgcagccgctgctggcgccgggcttcctgctgcgtgcggcgtacgagggccaggtggactgggaggtggtgtgggcccaggatccacggcgctactccgcctggcagctgctgctggagagcagccgggtggccgaccacgtccgccccctggtggctgcgggcgccgaccccggggacgtcatgggcccagcctgggtggcccgctctggcatcaggtgtgtctggaatcgagcgcggcatgtggtgcgtgtacaccaatgccagccgtgtgcaaggatcaaccatacatggaatgcactcttcaaacgacgctcaattacgcaaacagggcgctgctggacctgcaccgcggcgcctcgctcacgccgcagcagaaggagtggcggccctgggcggcggtgcggccgctgacgtggctggcgctgcttgagcggcactgcctgctggcgctggcggtgctcagcggcggcgccaacaacctggtggcccccagctccctcgtgttcgaccacctcacgcagcctggcgtggcggacctgctgaccctgagcctgcgccacacggcgcgtgaggccgcgccggagcggcgtcaggcgctgtatgccctgctgtgcgaggcgtgcgatgcgctggccagggtgctgaccgcgcccgaggccgtgcgcccggccggccgcgtgcatgacggcagcgcgcgtggcggagctggcggagcaggcggaggcggtggcgcaggtgggagtgccgcagcagggcagcagcagtggccgtcgctgcagcaacagaaggtgcagccgcagaaggcgcgggtcggcggcgggtcggcggcggctggcagcggcgccggcggcgccggtggcggaggcagggacgaggacggcgaggagttgggcatgttcctgcgccgagcggtcgcactgctgttcaccattgccatcaacgtgcgctcgccgccgctgcagcagcagcagcaggcgccacagcatccgtaccagcagcaccagatgcagcagcagcggctgcagcgtgggttcctactgccgcaggagcagcgcctgcagtcataccagcatatgatgcagccaccgccgccgccgcaagcgccggcaccgcagccgccagcgtctcctgcggcctcctgctggcgcgtggcgcgcgcggcggtaggcagtttagggccgccaaacgcaggcggtgccagggcgcccagcggcgctgctgccagcagcggcagcgctcgcggtggcctggcggcttacctgccgctgcttccctacaccctgcgcttcatgctgtcgagcctgaacgccctccacagtcgcagccctgcgctcttctctgagccgtcgctgctggggcccgagttctgcaaggcgctgcagcgaggcggtgacaagccgctgcggctgttccggcgcgccgtggcgccgccgccgggaatggcgtgggcgcgggaccggaacaagggcgtcaacgtcgaggaggtgcgggagctgccgccgctgcgagggcccggcgcggctgctgctgactatgcggcggcgcggggacagctgcgcaaggtaggtgtggtggcatgtggggccgctgctgctggctggcgttttgggtggcgtcggtcccgattaatgatcaatatgctattttccaagtaagtttcgagacacagagaacctcacaattaaacaacaaggttaccgtacatcccctttccttctgcatctttgcaggtgcttttctttgccattcccgagaacctgctcagctccgccgcagacgacctggcggccggcgacgacgacgatggcactgccgcagcagcagccggcggcgccggccagcagcagcctatgagctccctcggcgaggaccacgcagcggcggctcgcacggacgccggcgccggcactgtcactggcaccgctgcggcggcagcagcagcagcaggcggcgaggtaggctcggcggaggacgctgcggcggcagcgcggcagcaggtggtggccacggcggcggcgctgggccggcggggcttcgtgatgacgtgggtgtggctggctcgtgcgcggcagcaggcgctgctgccgcgcctcagtccgctgcagcgcgcgaggcggcaggcggtggctgcctttcatgcgctactgccctcggtggcgggtgctgccagggatggaggcggtgcgggtggtggcggcagcgctcagcggggcggggccgccaaaagccgcggcagcggcggtgagggtgctgacagaggcgcgaagctgccgggtcgcttcacggcgtacgtgtcgctgttcctggagcaggcgtgcccgctgcaggtcagtcggcgaagtgcgggggtatgcgaacgctgggctgcggccggtccgctagtgtgtctggcgcgcggcggacccctggtttcacctgctcacgtgcgttccgctccattcattggctgccgcacggacatgcttgctctctactccgttagttctcggttgctgacgtcccatgcccctccgatggtacacacctccgcaggtggagctgcagcagctgcagggggccctgcaggaggcactgcggcggctggagcagcagcagcagcagcagacgctgggtggcagtagcactggcgccgcagcgggtggcggcagtggtgctggcggggaacagcagcgcgacgtggtgcaggtgagagggttcggcgtgggtatggacacgttgcgttgcttgtaggcgcaacaaccgtcctgtagggacgtccgcccgcaccggctccgtggctatcctccgcgtatgtgcacctgctccgctgctgcttacttgcgcacctgccgtcgttgatcaagcacctgacgctcattccatcaccccgccacacacagctgcttgacctggcgtacgagtacacggagcggctggcggcggaggcggcggtgctggacgtggccaggtgcgcgggcaacggttggcagtagtggcaggcagaggcagtgcaagggcagtgcaagggcaaggcaagggcagggtaggagtttatgatgtacgcatgctccgcacggtctgattgctcatgcgggtacgctgtcccgcacggtctaagaaggtacagtagaggccgcacgaagcgcgacggaagctccatacgctcgttaagccttcttgccgctccgcgccgccctactttccaaccttccactaccgtattattcaccacatatctctatccgctcatccctccccccttcccccacacagccacgcgggccgccacgccgcctgcgacgcggcctggctggctgctggggcgctggagccgctgcggctgctggcggcggaggtgcgccgggagctgggccagcagctgccggggcaggcgccggggcaggagctggagccctag

SEQ ID NO: 21 - DNA, 2077 bp, Chlamydomonas reinhardtii
atggtgcaggtacacactgaatccggcagctggaaattggggcgaattggaatgcgcgcgaacgcttcccttcgttggacttgccggtgcaggtctacactgagccgttgtgcaggcggtactatggtagtgtcattggagaggcagcactgttccgcttttttgcgtacctctccgccatcgtgctggctctggtcgttgccttcgccaccgggggcttctgggtgaagctcacgccagataatgtgcaggcgacagtatcatacacacaggatgccatcctcatatttgaggtatgcgctgaatattcaggggggctttggtccggagcgggaaaggtctcgcatagtgtggccctagctagcgaaggctgcggggctgcaaacccatccttagcacgcgaaggggtcccttcaatgcgccacctgccgaggcgcaacagcgtggcaccgtttgcggctaactacagggtgcggagactgggcaagttgcgttctggagcacatcacctgtgctgaacgcggagttctccaacctgtatactgcggccagcgttcaggtatgctctccacctgttccatgtgccctgctcaccatgttgttgccccagtcctaaccacgttgccatccaactgcctgagtgggaaggttacctgcgtgtcgacatgtcgccacatgcggcctagccccaatcgtgtggcgcatgcgacgcacatgcatacaggtgtcgtctatggatgtgaacgatgatgggaaggcggacctgatcactttccaggccagcgtggccaatgacttcccagttcacagcgtcaaggcgctgttgcagcttcactactctctgacagtgagcgaaagcctgggctagctgtaagcttgtgcacaactgctggcaggcgtgtccatgaaatacagtgtgcattaatgccagctgatacgccggtgggcaggttaggcgttgcgttgttgctttcagcctggtggctgccttccatcgtgcctgctgtgccccgtgcgcactcgtgtttgccgggtgttaccaagcgcagggccacctgcagctggacatgtacagcttcgcgtacctggcgcagagctctccggctccaggggccgcactctacacggatggagaggcaagtagggagcactgctgtccctgcccccgctggtgtagcatgcatatgtgggaatgggctcgcacctctctcattggtagcactgacagacgctgcaacacatatgtgtctcgcgttcggaaccaacctcatgtgcttggtgcgctgcttttgtgccaaaaccgcagctcttgctgtcatccacgaaccagcttcaggaccggaactacaactccagatacaacacgccaatgctgaactccagcacgccatcctactccacagccgtgcaggtatgggcactacgtcaaagctcagcagccagtgcattgtgtttaccctgattccttgattgttaggctccagccgcctttatacgcaagctttcgacattcatacttttataatacccgtgtgtgcgcagccgtcagtagcgctggagatgcaaagcatcctgagcagctacctgagccgcaacttcaccaccacctacagcaacaactttcccgtctgggtggtgagaaccgtacgccgcacatgttgctcacttgctccttgtaccttttaaggtgtttgttaaggacccctgatgggtaacccgaatgcagggcggcacagggacctcgtttaatttgcaaatgcgaatacggattccgcccaaccaggtcatcttctacaggttagtcatattagcatggtagctgttgctaggctgggctcctggggcaacatactcacactcaatattgggcttgcccacttgtctaaggtccgtcaaacgtgttcgtcaatgcaggcctcaagccattgagatgctcaagttcggttggatccagtggcttgccacgttcattgtgctgtggtacctgctgcaatgggcagagtggtttgtgttctactaccgtttggtcgagacgcgggttgtttcagacctacaaccaaggcaacagcgtttttaa

SEQ ID NO: 22 - DNA, 2438 bp, Chlamydomonas reinhardtii
atgggcagcggggagaaggtgaggcgatggcacgcgtttaggagaatgtgaccaaattgcgcgtttgcgttgaagcgacgcgttggactaacctttcccgtcctcatgatctgatacagggtgtgatgctctgtgagcgaccaaagccctccgcggtcgactcgtcgcctgggctgaagccgtttctcccatcgtcggtgccctctaatattgagccgctggggctggtaccaacccaaaaggtgggcgagcgttatgtttcaaagcaccaccgtcggtggcaggcggactgttctgaacggcgcagcggacgtgccgtgcgcgtgcaggtgttccctcccagcctggcgcccaagcaggttagcgccaccagcaagcatgtgaagtacgtgcggaacctggagcaggagaaccgtgaggtgagttggcgctttagttcggctgggcggcatgcacaggggtagcaagactaataagcgacgtgtgaaggcgatggcggcacctgccgccagagcagcaaagcgcggtgcctctacacggctgtttcagggacgtggacttagcccttccttgttgtggtaactgcaggcggcgctgcgggaagaggagcggcggatggctgaggcggccaaggcggagagcgtgacttcgttcaagtgagtggctgtgtcgtgtgctgcccgccctgccaacttctgcctgacatcaccagacagcatctgggcgcgcagacgatacacacctatttaccttcgcctgcacgccccgacctcatccgtgttctccccacagcgcgcaactgcgagccgcaatcctgaccggagaagatgtcagcttctggcggccagctaaaggcgcggaggcggtccggcagtccctagcggagtccgtcgcacggaccgccgccctgggcagcggcagcccgcaatcaacagccgccgcagcggctgcagcggaggcggcgcgcaagcgtctggagctcacggcgaatgttagcgggttcgtggaggaggtggttggcgaagccaaccagaagctgacggcaacgagcaaggtcgccatggcctcgttcgtagatgaccttttctcagaagccgcgggcgcactagcactaggcggcgaggacgaggaggctgcagggcgggcagacggcacagcggaggccagcaccagtgccgccgccgccgcaggcggtgccaagcccggggcggccaaggccgcggccgcgggcgggcgcaaggtgcgggtggcgtcggctgcgggcaagccggcgtgggctctgagctcggagcaggtggagaagctggaggaagctgaggaggaggagctgctaaaattcgcggatgacctggactttgacaacttcatgtcctctctcgacgaccccgagctgcaggtgggtgtgtggtagggggcagcgcagggcgcggaaaaagtcataataagtagtagtaagtagtattaagtaaaataagtcttacttaccgcgatcgtacttaccgctactttgggggtccagtccgaggtggggtggggcccaggcataactggtttgttaagggcagggcagggcggggcagcaagcgggatgtggttaggtggagagagatagacggtggaggagcgatgatacaagccgagccaaaagttggtctttgagaaatgaaggggacagcagggcgtgaggaggctaggccatggctggagggggcttgatggactgaacatgacggtttgggtttgggttgaggtggaggcagagtcatgcggcaaagcgcagggcgggggcgccaaaggaaaagagtgcaaccagtgcatgaagatcttccttgggctgcggcggtggccatgagtgtccggctgcgcagtcacccaagtgatccgcccgcgctcatcttgcccccctctctattcgcccccctccgttattgtccccacaggagagcgtgcaggcgctgcgtggcgcggacggcaagggaccagcgccgggcgaggagaaggcctggcgccagaacctggtcaaggccatgaaccatgtggccatgcggcaggtggcggcgcggcgggcggcggcggcggcggcgggcggcgccgacagggatgacgcgtgcagcattgcgggcatgtcggagggcggggctagcatggtgtcacgcgccacggctgcgagccggatgaagtcagaggcggcggcggcgaaacgggcggcgctggcggagggtggcgagggcggcggcaattgggagtcgtcgacgcgcgcgggcgaggacgtggcgcggatggagcggtcaaaggcggcggcggcggaggcggcggacttcctgcgggaaaatcccgagctgcgggcggtgcactcaccggcgagtgtgcgcgcgatgatcaccaagactgaggcggcgggcgcgtccgggggcagcccgcttgcgaaggcatcgtga

SEQ ID NO: 23 - DNA, 4163 bp, Chlamydomonas reinhardtii
aggttgcatagctaacccagccaacgtccagccgaccccaaacctccaaacctccagcgagcgaacactatccgaggtgctcgccaaactcgcgaccgcgcgctccgcaactatggagcgagcacgccaaggtatctttcctttgcttattgtagcatttagtataatccacctgcgctcaatgtgcgttctccgtgcagtcatcgcgcatcggcccggccgcggcgccagcaaggagccttcacgcagccaacgtaccaggtgtgattgcactggggtcatcgccatgctggtactccctgaactatcgcatcctgtcgcgggcccggctgtctctttgcaccgcacccgacacagcgctgccggatcccacgctgccgcgcgggctcggtgcccccgaagcgcccgcgggagacgcccccctccgggcttttgctgctattgcagacgcgttaagcagcccgcctccgcacacagtcgctcatgttcgcgctatgggcgaagcagccacgcagccacgcgccccagctggtgcacttctgcgacaggccgctcccccagctctgggcccctgatccccgtgccacgttgctgcgcttaggagcgccgcgactgctcttcgggcaggcgcagcatctcgtgacggacctggtgatctacgagtcgcagcaacagctgccgcagccagggtttcagcgtaacccgcctgcgctgctggtggatgtgcgacgcagcctcaaggagcggatgcagcggcccccagaggacgcaaaggcctgctcgaacggcacattcattgcgttctttgtgacagctggtcacaaaaccgccgccaagcagctggctggtggtggcttggcgcgtgcgctcttctactcggacgagtggcgctgtggtgagggtggtcaagaccgcgttcgggggcacctctgttaggtcattaggtgaagaggaaggaaggggcagcaatcgcgcatggggttgggagtgtcacggctcctcgtaagcatcacggggtactgcggggttagggtgcgtgggtgttgcttcggcgttgctcacacgcgcccgcgtgccttgactaggttaaggataaggataagtgttcgtaccctttgcctgggtatgtaagagcacattgaccaaccaatgcgtgcattccgctgcggagccccctggcttttggtttctggtatgaactaccctgccccctttaccctgtcgacaggcccatgttcgtgccgccgacgccatggccaccctacgtgtcaagagtgaacctggagccggagctgctggactggtatgcggacttcttcgacttctgcgggctcccccagtaccccacacgcgactcgctgtttctgcctgacgtggtgctgagcgacactaccagcggcgcgccggcttccgcatcaaggacacgctggtgcatgtgcaggtaggatcggcgccggtcgggcagcaggaggctgttcgcgctctgcaggctgccacgctgcgcctctactccatgcttcctttctcatacattgacgcacccgtctcgtgttgctgttgccttgcgcaagttctggagagtgctgccgacctgggagcgccgcggctgacgtgcagctgccgtaacttgagcgacctcgcctcaattgcgcacgggtgcctgcacacgcagtgcgcccagcttgtcacgctgccgcagccggggccagccccgccagtgcacgtgctcatgccgcgtggctcgcagacgccccggagcgccatcctacccggcgactacttctggctgcaggaccacacctttgtggcctgcgcggcccagacaagcagcattcgctgcacccgcagcggctgcggggcggagtgccagcacgtcaagcaggtggaggaggtcttcgggaagcagctgccgccggcagccctcggctcccgccacaagccgccaaatgaggagcccgggcctgcaagtgaacaggctggcgtgatagcggtagcagcggcaacagcggcagccgaaccgccggcggaggtggcatcgccgccgccgccgtccgtgcggtaccccttcccatgtggcgccggcacagctgatgccatggccgctggggaggtgggtgtggcgtccgcgaggttgcgggccatggaactccaggcgtctgctgcccgcggtagtagcagtgatggcggcagctgtagcagcgtcggtggcagtggcggtggcggccgcagcttttgggggctggtgggtcaacagttgacctggtgccgccactaccagccgggggctgctgcgcgtatggctgtgcctactcgccgcggctatttcgcagcaggcctgtcactgcgtacggctcagacacgattggcccgctgcgggcgcagctctaccagctcacttcgggccgtggccgtgagagctgtaagctgtcatatggcggagcagcggacggcttgtctcgctacagcagccgctccttcttcagcctgcgccacatacaagggtatgcagcattcctcctgcgctgtgtagtgccgagcctggggcttacaatgagagacgcctgagtctcgcaagtacgcggtggtctggtcgcgtaccggtagggtttgctgtccaaccctagggctttacatctggtaactgcccgggacatagcactgacgctgtgtgcaactacctgagttgctagtgaggcatctgtctgcgtcctctctatcgggtcttactgtaattactgtcaacctggcgtcaacttgcggtaatgctcttttacgctcaccgttaccggcaggaacattcctaccaagggtcctgcacaaccctagtaaccgtcctgacacacggggactattttgctgtccctggacgccaaacccggtagttctcactacctcccttaatcaggaatagcacatcacgctgcggcatcaatgtgctcaatgtgaaggcgcagcatgacctcgccagcgcgacgctcccccctgacccagaccggccctctcagttttcggagacgcttttcggctcgcatggcatcagttcgaggctcggctggaccgctgccacgtcgtcacctgccccatctgccagctgtccccgcgcaagctgatatgcgacgggacggccgtcacctaccagatcgtccactattgcggcgtggcgctcaccaccctggcgccggttgccgccagcagcagcgagggtgtcggcggcagcagccgcagcaatggcagtggcggcggcgccggcgccgtgagcacacccgcgcagacggcagctggtgcccgacggaggagggccgtgccgtgctgagtgacgtcacacgctgctgggcagcggcaagggcgtgtatggtcgcgcggtggctgggtggatagcagcgcccgacatggccgccttttctaatcacctgcatgcggactgccgggaggtgactacgggcatcttgggcgtgctcctcgctgtcacggcaagtggtggcagcgagcctggatcgcccgcgcgcatggccttggtcggactggtagactgcctgggcagcacggcacccgcgtgtgcgtacctgcccgcggcgtgtctgcatgtcgcgggcgtgtggctggcgatgcaccaccctgagctgcggcagctgcagcaggaggagaagcaacaggagcaacagcagccatggaacgacggggtagccctctgttcacttgcggcgctactaaagtcccgtgcgccggtcctagccgctgcttgtaagccattgcgtactgcgcaatccgccagccgccgggcaccctgcttccagtggccgcctttgtagcgcgcctgagctgcctgtcggagaagtgcaagggctttggcggcgggccgcagcttgcttcgtgcggagcagcatccgccgacacggacgagtgcctgcgcctggtggcctatcctgcgtccaccagctgtacgccacgggcttgtgggggtaagaattgtacattgtgatacacgtagattatgtgaagcaggatgtgaaggtactttacagggatgtgaaggtgttggggggggggggggttgcttggtgattatataaacgcagagctcgtctcttaaagctttgaagcaggatagggctatttcagccgtttcctgagcactagcctgggcccggaaagctcagatttta

SEQ ID NO: 24 - DNA, 2829 bp, Chlamydomonas reinhardtii
atggctccgacccaagcgggccacgacacagcctacctcaaagagaccgtaggcgaggccctcgctcggggatgcgcagccgctattagcgcacagccaaacgaccccgtggagtatctgggcctatggctgctcaagtaagcggggttgcatgcttatcgtctgccttataaggcatgcctgtgctaatctttgcattgcaactgcagatacgtgaaaaatgctgaagtagaagggaacttttatcgcgagcggcaacaggatttgcaaaagaagaaggaccgactggtgagtgagcgtcgcacaggaaccgcagtaccacgttttaggggtattgagaaaccgttcgcgtgggtccatgcgcggtcgaagggggtgagggtggccgcggcctgcgcggggggtctgctgacacgcacggcctcgggtgctccaaccgtcatacacccacttcctgtcctctagcgttctgccccacggtctcatgtgcctaatgcctaccgcgtccattcatctgccaaggtcaaggaggcgcagtcggagcaggcagccaagtcagtcgcgctcacgcgcaaggaggccgcggacgcgctggcgctggtgaccgccgagccgcgcgagctactggaggccgcggtgaaactggtcaagcagcacacagccgcaggcgcagcatatgccgccgtggtagcagagcctgaggagccggactgggtggcgccagaggacgacgaggcggcggcagtggagacggaggacgaggccgccggcggcgccgcgctcgcagagggcgaggagccgccgccggagcccgagccggagccggaagcggcgccggaggacggcgagggcgatgcgcccgcgcccaagattccgcgccccgtggactacagcaagaagtactttgcctacgtggccgccagtgcggggcaggagcacgtgcttgaggccgacctgtaccgccccgcgccgccgcccgaggacgccgacgaggacttcaagcccgagccgctgccgtacagcttccgcgtgctggacgagaagctgcccatgctgtatgtgcccaacgtggccgccgaggagcgcgtcaagttcttccgcaagttccccaagataggctcctaccaggcctgcggcgttgcgctgccggccagcggcgagttcaaggcgctgctggcggcggacacgctgttcccggagggctcgggccagccgctgagtgccgacgaccgcgactttgtgtgggaggtgtcgcagtcgctcagccgcgcgctggaggcggtgcaggcgcgtgccgccgaggcgctggcggccacctccgcggcggaggcggtggaggagctgaaggccaaggtggcggagctgcgcgagcaggcggcggcagaggccgcggcggcggcgccgccgccgcctgccgagggcgaggagggtgagggcgaggcgccgccggcggaggaggagccaccggcggaagaggaggcggaggaggaggaggaggaggccgaggagggggcggaggagggtgctgaggagggcgaggagggtgaggaggcgccgcccaagcccaagaagaagaagaaggtgttcaaccccattcccgggctgcaggccgccattgagaagctcacggccgcggcggaggccgctaccgaggccgacgcgcgggcgcaggccgccgtggcgctggagaagcaggcgctggatgaggtggtggcgttggcgagctcacactcggacgcgacgctttccagcctgcgcaacatgctgagcgtgccgcagggcacctaccacgtggtgaaggcgctgctgcacctgctgggccgccccgccgcctcgttctcgacctggaagcgcgcgcacagccacttcagcccgcggctgtttgaggacatggccgcctacgacgcaacggcggagcgcgacatggcggtgtggggccgcgtgcgcagctgctacaaggcggcaccggcggccaagaagctggtgagcgcggcggggttgggggctgcgggggagctgcgcggtgtgctgaggggagatgcggggtgatgcaggctgtggggtcacaggttctggaaaaacactcttggccgggcgggaagagattgaagggggttgcatgattatgtgctgccagtgatgctttcaagcgatgcgttgtgtgcctggttgtgccgctgggagcgctgtcacagcatccggcttttcttcctgctcttgcccttgcctttccaccttctgacaacacccgggcacgctttgcttgtccctccctttacaatccctcaggacgcggagatgccgaacacgctgtttggcagcgtggctctgatgtacatcaagcaggtgcggcgggtggcgcgcaaggcagtgctgcagcgggagctggcggccaagctggccaaggcgcagcaggacctggccgacaagcaggcggcgctggttgaggcggagcgcgtcaaggccgagcgggaggcagaggaggcgcgcctggccgcggaggcggaggcggccgccgccgccgaggcggaggccgctgcgcgggcagcggctgaggcggaggcggcagctgccgcggaggcggcggcggaggcagcggctgaggcggctgctgcagcggcagaggcggcggcggaggccggagagggtgaggcggtggcggagcgagaggctgctccggctgaggccgaggctgctccggctgagggggaggcggcgccgccggcggagggtgagggggaagcgcagccggcccaggaggggtcgaacagctcgagcagctctagtgactcgtcgagttcggaggagtccaaggccgctgcggagtaa

SEQ ID NO: 25 - DNA, 396 bp, Chlamydomonas reinhardtii
atggcctgggaagcctacattacctccaacctgatgtgcccggtggactcagagggaaacactctggacagcgcagcgattctgggcctggatggcagctcagtctgggcgagcagcgccgcgtttcaggcgctgaacgatgaggaggccaggaagtttgttgctgcattcgatgacgtctccattgcttcggtgatgcttgcgggtgccaagtacctgaagacttctgcagacgggaccattttccgcggccgcaaggacaagagcggctttgttgctcgcaagggcgcccagtgcatcattattggcttctacacggatccgccggtctccgcccagacctgcaacaaggtggtggaggctctggctgactacctcgcggaccaggggtactaa

SEQ ID NO: 26 - DNA, 1668 bp, Chlamydomonas reinhardtii
  misc_feature (143)..(242): n is a, c, g, or t
atggtaattacggaggttcggcaggacggcacaccggtggactggagcggctcacgcttggtcgggaacaaggactacactgttattgcagagccagcggcctcgattttccaggtgctccagaacggcaaaagtgaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggagcaaatcgaactgtcaagtctggagcacctggaaaatcgaggccgctggctctgcaataacagtgtaatccttgttcccgaccaagcgtgagccgctccagtccaccggtgtgccgtcctgccgaacctccgttattaccatcgtgatgcctgcgctgttgcaagctgaagccaccgcgccctcgacacatgacttaagttgctcatgacctcgcaaccgcagcagccaacaccatccggggccggccctgcgtgtacctgctgcgcgcccggctgaaggacgggcccaaggctggggagtgggtcaatgtgtacctcggctgccagcaatccgacacgctgagctactcgcgctgggacgcttacctggtccatggcaagtccctgcggtggtcggtgcgctgccaagcattgcatggccggccggggcccacacaggagccggccaagtgggctgggtgggcctggctgctgacacactgtgatgctgcagagctgcggttcattgacctgtctgggctgactaaggagcaagtcttcagggtggagcgcagcttccttgacaagtacgactttcccttcaactctaccgacaaccgctgctaccgcctcactgtcgcgaccttctggggcagctgcagcattcccaagatgcccatcgagctcaggcgctgggtgggggaggagtggtggtacgcggggctggcaaacctggagcagctgctggtggagcctggcgacgtgcggtcctgctagtgggggcggcgggcaggctgccgaccggggtgccgcgcctgcgcaacatcatcgcgcaaatcctcctgcatgcctgtggcaagcagaagttccgcaccacaaagagcagatactaccgtgagctttttggagtacagagaccctggactgctgcagctcgccaacagcctcggcaagcctgctcagtcggtggcgtgtgcggctgacggtgcattgaacacccggaacgagttcacgcaccctggcagcgtggctgccatggaccaggaggtctccgagatgatggagctcatcacgccgccggagctggaggacaagtgccctgaggagtgcatgttcctcacggcgtacgaggacatcaagaacgccttcccgcaccgcttcagccaggtgagcagctggggtgatctcacggactggaacgcacgaactagccagcttgccttcttgccttgtcattgttcataggtctgctgttgtgtccggtgcgtggactgtggggtgtgggaaactggatgggaaactgtacctctgccgttcttcactcttgcgtgtcaccgcctgggtaggacaaggggcatgccggcgtggctatggctcaactcacgttccgcattcttcctcccgtgcactgtgagcaggttggtggcgctcgacagcgttga

SEQ ID NO: 27 - DNA, 3900 bp, Chlamydomonas reinhardtii
atggtgcaaccagtctcggtcctcacgccaggcgtgcagagtggacttggtggactaggtgcttcgcgtcctggggcctcccaggcttggccgcgtcgacctgctgttctgagtacattcctgggcacctccatgctgtggcgtgggcatcgtgcggcttcttcgacgggtggccatgtggcgcagcatgtatgctcggcgtcgtccaagtcggggcgcacagtcaagataacccggcggcgtggttcaggccacagcagcagcggtggcacgggactggtggcggtgcccgccgacgggcccgccacttcgtcgggacgatacagcggcagcatgctgggctcggcctcacggacaacctccgggcggagtactacgtcggcgccgccgcaagtgcgggaagcggagtacctgagctcggacaatggcagcgctagtgacaccaacgcattcgcgtggggctggtgggagtcgctgccatcccgctacaaaatcatcgtgggcacggcagtgtcgtttgtcatctgcaacctggacaaggtgggagcaggggcgggaaatgacagggccgcagcgccacaaagaattatggaactttggggcgctcgcaggcctaggcaggagggctgcacgctgcgagtggcgtgggagtctggtgggctggcagggtatgcgctggcacgggcagtctctgggcagcttccaccacctcctcgcggcaaccaaaacccctgtgcggccccaacacatctcctcagcatcatcttcaatcaccgcgctacgttcctgtcatgtctcctgcatgccatatacggatgcaaaccaccgacgcacccaacaccaccaacgccaacgccaataccacagcaccggccactcccagtttcccaggcgctcccaacccacgtccccgaacccctttccccactgaccctcccatttgcctctgtcaggtcaacctgtccgtctgcatcatccccatggcccgcgactttggctggagccccaccgtggcgggcctggtgcagagcgccttcttcttgggctacatggtgtgccagctgccgggcggctacctgaacagcaggctgggcggccgccgcattctgcccgccggcgtgctactgtacagcgccgcaaccggcgtggtgccgtgggtggcggccagcgtgccgggtgggtgccatgaggagatgggcgggggcgggggggcgggagccgttcattgggcaacggggtgatatcttcacaagggcggaagggagcggaggctgcgaggtatagggtatgggcacgggaggtgggcgggggcgaagaggagtagtaggcccagggcgggcagggattggaacacaactggcgtgctagaggtacggggttggagaaatgtcatggcaggtaatacggacgtggtttacaggcagccacgtaagggatcggaatggattagttgcggggcgcccgtcagaggcaagccagggggcgaacgaggccaacggtgatgacaggcctctagctaaccttgacaccttccccaactttccaaacccatgccatcctccgcagcgctgtgcgtgtcacgcgcctttgtggggttcggccaggccacggcgccctctgctgccaccgacatgattgcgcgcgctgtgccgcccagcgagcgcgcccgagccgtcactttcgtcttctctgggttccacgtgggctccatcctgggcctgctgacggcgccctggctgatccagcattacggctggcaatccgtgttcgtgacctttggcgcgctaggcttcgtgtggtggctgtggttcgagcaggtgggggcctgagtagagcggaggagagtaggggaggggtgcgggcgcagcggatgagcagagacagtggaaggggtgggatgagagtagggaggcgcggcgtaataaacagggcggcggtgtacgatgctgaatgtataccttcgagttgggctaaggcaagcggccctctgtattggaacaccgggccggcattaaaaacctcctctgcgtccccactgtccttacgccctcgtgtctttctgccctgccttcttgcagggcatcatgtcgcgcatcaaggctgaggagcccgacttcgccacccgcctggtgtccgactcgcgccgcatcgcgcccatgaccgacgccaacagcgtcacgtccgcctcctcctccgtagtcgtgaccaacaaggcggtggccaaccggggcgcaggcgcggcagccgccgcggcggcggcagctgctgccgcggcggagccgccgccgatgccgtggcgcgctttcctgcggagcaccccggtctgggcgctggcctacacacacttcgccaacaactggttccactacaccatgctcgcctggctgcccacctactttgtggacacgctgtctgtggacctgctgcatgcgtcccaggtgcgccgggaccggaaaacattgaggattgggtagggtggggtgttcatagcgttcaatgtagtagccggcgacagcgcacctgaagcgcgccaggtttcctccagaccccaccaaacatcatgttcaccggcccccgtcgcagaccgcgctattgccgcctctggccggtattgccgcctccgccgcggccggcgccgcggccgacgcgctcatcagccgcggcgtgcgcgtgccggtggtgcgcaagctggtgcagggcgtcgcctttctggtgcccacggcgctgctgctggcggcctgcacgccggccatcgcggatgacagcggcctgacggtggctgccatcacggtggcgctgggactgagcagcttcagcctggcgggactgttctgcacacaccaggtgaggaggggccggggaaggggcacgaaaggggcggaaacatcggcagacacggtacgagcttgtgtgcatcccttcccgccgcccgccgcagcttatataaaccgcccacgtaaccgcccacctcccatgcccccggccgccacccgttacctcacaggacatgtcgcccaagtacgcgcccatcctgctgggcctgaccaacaccaccgccgccgtccccggcttgctgggcgtggcgtccgtgggctacctgtttgagcagacgcagtcctgggaggcggcgctgttcctgccctccgccttcttcatggtcacggccgccgcagtctacacgctgtgggggcgtaacgaccccatcgacttcgacgccgccgacaacggccccttcaggtgcgggtgcggtggtgcgagcaggggcattgggatgtggacaacggggcgggttgtgcgtgccttatcacgcgccacaggcccaggccgccaccgccaaatcgcggatgacatgcgtggccacacagccgaaccggactcggttttgagcagcggaatgcgccctctctttccttctcaccctgccaccgtgtctcgttgcacaggtttgagtcgcggatcgctgcgatcaagaaggccgttgacgacgcctttgactttggccagaagccctcggccggcactgatgtggagcgggaggtggacgtgcctgaggtgccgccccggccgccctccagcctgctgggccccctggccgacctggtccgcggcaccagcagcgccaccgccagcggcgacgacggcgacgagggcggcagcgtgcgccgccgcgtcggcggcgccgcccggaacgccgctggcagcgggcgccggaccagcggctccagcagctcgggcagcggccggcgcaccactgtcgggagccagagccggcggtcgaccggtgggagccagagcaaggcgactggcggcggccgccgggtgcaggaggcggaggaggaggggccgggcggcgtgtgggagcgactgcgcgcgctgctgggccagccccgcgagtactaa

SEQ ID NO: 28 - DNA, 587 bp, Chlamydomonas reinhardtii
atggagaagctacgcgccgcgggcaaggccgtggagaccgtgttcgtgagcggcgaccgcgacgaggcctcgatgaacgagtaccacagccacatgacgtggccggcgctgccgttctcggacaagaagcgcaacgacgagctcaactcgtgagtgctatgctccattagttggggaactcttctttgccaaggggaaacataatgagtgcgcacctgtccaagcgtggggtcttaccttgatggtgtgtgtgttccagtcttcagcccctgaagcagtgcgcatgcatgctaggtggcagttgcttgccgtatgccgttgccgttggactttctggcttcctcacatgagccgttgctgcactgtgccctcgtaggtgcttcgaggtggagggcatccccacgctggtggtgctggacgagcagttcaacgtaatcacaaccgacggccgtgaggccgtggcgtccgacaccgagtgcacgcgcttctcctggcgcccgcagcctactcatcagctgcgtggcggcaccatcgacaacatcaacgaaggtccctgtcatggtggtggtggtaggtgcggcggatga

SEQ ID NO: 29 - DNA, 2062 bp, Chlamydomonas reinhardtii
atggcgcctgccgtggtctgcgatggggacgtgtgccgcaaggtaagctgcacgcatctcaggttcgtgttcatgcccacgtgtcctttgcgcatgccacccggccgggctaaagtgttgttagacttcgcgctgaccggccattcggttggcgtatgacttcaggtggacgctgaggaggccgcagctgccgcctcccccgctcctgctgcggccgaggagcccaaggtcttccagattctgggcgactcactgctcggccccaacggcactcaggtgcctgtctccagcatcactggtaagtgcgtgcgtcgggggcctgggccggcaacttttccaacatgccgtcattcggacacagcttgacaacccttacttcgacctcaaatacccaggtcctggcaaggtggttgcgctgtacttctccgcgcactggtgcccgccctgccgccacttcacgccccaactggcctccatctacgccaacttcaagaaggatcacgcacgcaaggctgactgggaggtggtgtttgtgagcagcgaccgcgatgaggagtcatttaaggagtactttggcgagatgccgtggaccgccctgccctacggcaagcgtgaggccaaagcacagctgtctaagctatacaaggtgcgtccggcgtgcatggtagcttgctgatagcttgctatgccaggttagtagcatggaaacaagctggtaatacgcccgcgtttgggtttggtaggtcgcaatgacacatacagttgtcattgcacaataatccgcgtctctccatcctgcacctacccaagaatgtcccctgcctcatcccggggttacaccccagcaggtgcgcggcatccctaccctggtcatcctggatggcgagaccggtgaggtgatcaccacgagcgggcgagacgccgtcagcagcgacgagaagtgcgagggcttcccctggcggccgcgcacattcgagcagatcatggagggcgcggtgctggtggagcccaagacaggcgctgaggtgccggcgctggagcggctgcgcggcaaggtgtcactgctgtacttttccgcgtcctggtgcccgccctgccgccgctttacgccgcagctagtgacggctatggagaagctatgcgccgcgggcaaggccgtggaggccgtgttcgtgagcggcgaccgcgacgaggcctcgatgaacgagtaccacagccacatgacgtggccggcgctgccgttctcggacaagaagcgcaacgacgagctcaactcgtgagtgctatgctccattagttggggaactcttctttgccaaggggaaacataatgagtgcgcacctgtccaagcgtggggtcttaccttgatggtgtgtgtgttccagtcttcagcccctgaagcagtgcgcatgcatgctaggtggcagttgcttgccgtatgccgttgccgttggactttctggcttcctcacatgagccgttgctgcactgtgccctcgtaggcgcttcgaggtggagggcatccccacgctggtggtgctggacgagcagttcaacgtaatcaccaccgacggccgtgaggccgtggcgtccgacatcgagtgcacacgcttcccctggcgcccccagcctttcgagcagctgaccggcagcaccgcgaatcgtatcaacgatgggcccgtgctggtgctggtggtagatacggcggaccagaaggccgcggaggaggtggctaccagcgcgctggccgaggttgcggctgccaccaaggccgcgcccggtggtgacgactggggtttcctgtgggcccaccgcggcgaggagattgccaagcgtgtgctcgcgtttgcggggttggtgaaggactctgaggtggagctgccggcggggcacgcggcggtgatcattgacgtgcccaaccacgaggcagtatgggacctggcgggcaagggtgtggaggttagtgccgtggggctgagcggcgctgtgtcggacttcaaggcgggcaagctgggacccggcaagaagctcggtggtgagggcgatgacgacgatgagtga

SEQ ID NO: 30 - DNA, 6905 bp, Chlamydomonas reinhardtii
atgggttgctcgtcttcaaaggatgaggtggagctcgcccagcaggtgcgtttgagcgactcaggagcagcggtcccgggtttgggttgcgtttaactcgcgctcttttcgtggcgcgctgcataatataagtcagtggtatgaggggccctgcgtcttatgttgaatggcgcttcggtttcatgccctagcgcaacctgggctcgcggctgaaagcagcgtagccctcaatgtcctgggcaattggggttatgatttggtgctgaagatgagcgcggcaagagctctctagtgacggacacgggctgcgactaaagtgagaaagtcgctgttttggcagtcccgcaaggctcctttaacccgcgctctcgagacattgacagtgaataggcaaacggtccacgagtcttggactgtggagccgccgacagcggcacgcgcacacgctgactcgcggaattcttccgagtccttttcccccgtgaccctcctacaccatgtgcctgcaggtgctgggtgcgaagaaggccgctgacaccaaagcggtgcggcgactgtcggcgctggggctggaagacggggaggtgtggatcacgcgccagaccacggatatacgcaaggtgcgcgggtgccccagcttgagcgcggcgaacctgggcgaacgcagggatgggttggcgcgcgtgcgggagctggagatgagacctcggattgcaacaccggccccaccgccccaagggtttgcgtgggcacagtcctacattcacaaaagtttgcaggcggtttgctctggcgctaaggcccgtcgtgttggggatgggtgggagctagcagtccagttgacatgggaggctgcacacagctgggacaggcgtgcgccagcatttctaggcccggagcgctggtccattgcatccagcaagccatgacgtcgcatctaagtcgtacacataaagttctggtaccttgttaacaacgccactgctgcaggtgttcaagtttgggcagcaaatcaacaaagggcagttcggcgtgatccacgtggtcacagacgcggcgggcaacaagtacgcgtgcaagcagatcagcaaacgcaagctgacagggcccaactccattcgcgacatacggagggagattgagatcatgcaccaccttcgcgggtgagctgcgtgcgcgcgggctgctgggacggcggtggtgccgcgatgattctggtcttggtctttgtcgcgggtcttggtcgtgggtcttggtcttgggtcttggtcgtaccacggcgcacaacgcagcgcaacagcaggcttggcggccccgctgggtgcttgtgaagcagtgcgggagcaccaagcctgcgcaccatcatcggggccggatgtcaccttggcatgcttggagtgggcgcccttgtctccttcacagacaccgtactggggtagaacaagcacctacacgcaaggacatgcgcacacacgcgagcacgccgcctgacgcgctggtatgtgtgttggtatacaaccgcgcccacaggcaccccagcgtcatcaccttccacggcgtgtacgaggacgtgtcagacgtgtacatggtcatggagctgtgcacgggtgggtgggttgggcgggtgggtgggtgggtgggtgcggcgctgggtattgtggtggtggcgatgggtatgcaagtctaagtccgaattaaccggcatcaaaacaaacctgatgcgagttagcggctagaagtccgttcggatgcaggccacaacaggccaaataagggggccggtggtgttcaaggtggtggaggggcaggggtggcagggcagggcgtggaggcagccactcgtgcacgtgccagccacgcactagcacatttctgcgcatgccgttcacacgtgcgtaccgcaccgcgcccaacccggcaggcggtgacctgtttgagaagatcgagaagatgtccactgtcacggagcgggcggcggccgcgctgttccgggagctggtggagtgcgtggcgtactgccacacactgggcgtcatgcaccgagagtgagtcgcgcgttgctggctgcgtgccgcgagctgttttgtgtgtctagggtatttgcttgtcacgcgttggcctgcgtgggtctgcgactctgcgttgttttgcgtcggtctgcggaggcctggtgggggggctggggcgctggtcgacattggaaatatggctcatgtgcgaggtcttcagcaccaccgctgctcagccgaaaccctcctccttcacctgctcgtcctcctcctctctgtctctcttccccaccctcgcagcctcaagccggagaacttcctggtcacggaccgcaccggcgacgcgcgcatcaagctgtctgactttgggctgtccaccttcttccgcgaggggcaggccgactttgctgacgtgctggggagcgcctattacatggcgccgggtgagggggggcggcggcagagggggggaggcacactgggggttaactttgaaccaatcccgtaaggaaacagttgcgctgcaaggagaaactgcagactgggggattgaaaggttaaggcattgggaacatgataccaacagggacaatggggagagggaggagggttggggcagcgagagcaggaggttacggtgtgagtgtgcaggttgggtggctgcagggtttggcagggctggcggtggcaggcaggggtactggtggtgtgtgtggattggaggttaccgggctgcagatgtgccctgtgtgcatgtggcctgggacaggggcccagctcacacacctctcacttgcgcctgctcacacatcagcacccacccacccacctgcttagtacttgttcccaatgtttttaaccttgcaacccatccacccggcacccgcctacgcacccacggcccacagaggtgctggagcgcagctacggcaagagctgcgacgtgtggtcgctgggcgtcatcctgcacgtgctgctgtcgggggcgccgcccttcgccggggccacggacgcggaaattatcaaggcggtgcggagcagggtgagtggccgcacctacagccttgttgtggcgggagttatgtgaagtatggttatagatcgcgcttcttttggtgggagagcatgcgaagggcgtgcatctgcccagtttgcagacgagtgcgagagggctcggttgcaccgtgaacgcccatagtcacacacacacacacacacacacacacacacacacacacacacacacacacacacacacacacacacacacacacacacacacactcatacgcacatgcacgcgcgcacgaacccccgcaggatgtggacctgtccgccaagccctggcccgccatcagccgccacgcccgccacctggtgtcgcgcatgctggagaaggaccccgagcagcgcatccaactggaccaggtgggtgggtgggtgggtgggtgggtaggtgggagggctacattcatgatgcattaagaagtgaaggagtagccagtacagcaggcgcgtcgttaccgatgtccgtgaagctcagcagccagctccagcgcgtagacccgccttcgggggcaggggggttcgcgagtggagggcagtgggaacagggtacgcgaacagttggaacaagacacagcgggcagcacactggctggttgggtttccacactagggcaggggcacgggtgaggagaaggcgggtagctgcacgagcgaggctgttgatcggagggcactcgaaaacaaggactgcgcgcgtgggttgctgagcagaggggatgtgggacgggcgagcgtgtcgcatgaacacttgcaagctgatggccttataggcagcagttttgctgctttccgttccctcatcaacgctgccgccacacgtgctggtcccgggcgcaggtgttgacacacccctggctccggttggacggcaccgcgcctgtgcgggcggttcccagtgagtaccaccgcgcgctatgagattgccattgtttgtgtgccacacatgaacggctacccacccgccaggggatgtatggttgccgctatcttgtcgcgtttccagcgtcagctgccccttgttactgttattgccgccaccctactcatcactgcttccttccttcctgccccttacctctgaaccatgacgccactccgactggcagcgggtgtgcgcgaccgcgtccgccagttccgcacgctcaacctgctcaagcgcgaggcgcgccgcgtcatggccgcctcgctgccgcccgaggaggtggcggtgagtcgcgtgtgtgtgtgtgtgtgtgtgtgtgtgtgtgtgtgtgtgtgtgtgtgtgtgttagaaagcacaaggaagacaacgtgtgtgtatgccgttggaggggtggcaggcggatgtgtatgctgggtgtgtgtgtagggtgggggctgggggcagggtgcagccaggggagcgccgcagatctttccaagctgtctccagggtatcgtgtcagggcacccggtcgcaatggggtcgcactcccctcgcggccagcgccatgcccacctcccaccccatcacgcccctcccatctttacgtgccgtatctgatcatcgctgtctgctctcgccgcgtcgccgccacacgcacgcgcagggcctcaagaacctgtttgaggagctggacgccaacgccgacgggctggtgtcgctggaggacctggtggcggggctggcgcgcaggggcgaggcactggccggcgaggaggcggcggcgctgctgcgaagtatggacctgaacggcgacggattcattgtgagtgccgggtcgtgaactcgggatcgtgccgggtcgggcggggtgtgtgactgcggtaaatgctggagatgggttgtccgcgggccagcgtgttgtgaggatgcattatgcatcagcgataagtgcaacgagatgttatacgacacatgaaaggaactgaggtgacagtttatcagacgcgcttctggcacctgcgctcttatcagatagttacatcatatcaatacccggaacaaccacagcatcgttatgcgtgtgcgtgcatgttacgccggtgctggtgcctggctgggtgcgcctttccgttgcctgtcgtcacccaagcaaccctgcggcgtatggggacagcagggacgcgggagggggggagcctgtatggatccacatgaataagaccccccacaacccgaacgaggaacggaaagcagctcccccttaaatgctttcacctcgaattgtcagcgccaatgtcagctgcgcttttgccagctgcgatcttatcaccgcaaactatcccatacgcatagtagcacatcgttttgtcaggtcaaattatcattctcaatgcgccccacctgcgcctcaactatgccccaggactaccgcgaattcgtggccgccacctacacgctgagcaagctgcagcagagcgacgtgctgctcaagaccttccgccacttcgacctggacggagacggctacatcagcaagtgagtaactgctggtgcaatgcctcggtggggtttctcacacagagtgccgccactcctcccgtgcccctacctaccctgccacgctgtcactcacccggcggtctccccccccctacgtgacatctgtaccattgctcctggctacgccctctcgtcttatttaacatgcatggaaccccctctgtcacccgctgccaccccctgctgccctctgccagggaggagctggccgccgcgctggcccagctgcccgccgccgccagctcggccgcctcagcgcgagagagcgtcacggggctgctggcggaggcggacttggacaaggtggggccctggggggcctgtgggacctgtgaaggcggccgcgtgtggccgtgcagcctccttctccgccaccttctgccgacgtcctcctccttcgccccgccgccggacgcccgcgctctccccgctctcacccttaactctgcaaccccgcctcccctgcttgtatgctgttcccaatgttgtaaccttgcaacccccgcttaaactccacgcaggacggccggctgaactaccgcgagttctgcaccatgctgctggccgcgccggggctggaggcgggaggcagcgaggcagacgccaacgcggccgaggtgcaggcggccctgcggctgtccggaattgacctggactcggcggggctgccgggagccttgaatggcaacgcagcggcggcgctgccggcctcggcggcggcggcggtggcggctgcagtggcggcgggcttccggcccgggagccacagcaccaatgacacggcgtgggacccgagcttcggcagcggcaagcgcacgagcacggggggcggggtgcgcacaagcacgggcggcggcattcgcacgagtccgagcggggtgcaggcgagcatcggcagccggccgcaggcgccgtcgccgcagcggtctgggtcgctggcggcggcaccgccgtccagctcacaggcgtcgtcgcggtcgcagcagccatcgccgatggtttcgacatcgcaaatgggcatgctgcagcagcagcagcagcagcagcagcagcagcagcagcagcagcagcagcagcagcagcagcagcactcgcgttcgcagcagcactcgcccatggtgggtggccacaggctgtcgtcggcgcagtcacagtcgcagtcgcagcagctgcggcagctgcagcaacagcagtcccgcaagcagcaggcgcaacagcaacagccacaacagccgggcgtgtgggcagacgacttcagcgacgctgggccgctggactcggaagatgaagacatcatgaaggcgtcacggcggcagccgcagcaagtgcagacgcagtcgagtcagcagtcgcatcgggcgtag

SEQ ID NO: 31 - DNA, 1325 bp, Chlamydomonas reinhardtii
atgtcggagacggagaagcggaggggtggcattatcccgttccgcattccccttcccaacccgctggcctggcggccgcccttcattccgggactgggccgccgccgcaaggaccgcaccaagcactttgcgtccaccagcgtggtcagcgtggccaccatcagcgacagcgtgctgcaggcggcgggcagcggcgcgtctgcggccgccgcaccgccgccggtcaaggtggcgctgaagcccgccagcgacgtgttcgccggcgccctggctcgcgctgcctcccagtccaccatccacccgctggacacgctcaaggtgcggctgcagaccagcagggctcgtgccgcctcggctatgccgccgccgcccggactgtccaagattgggcagctggtgccgccgccggctgcacccggcggcggcgcggttggggcgctggcccgcttcgacggtcgtgcggtgctggcgaccctgggcagcctgtacaggggcgtggtgggtgctgccagtggcgctggcatcgccattggcgcctacttcgctgtgtacggcgtggcgtgcaacaccctgtcgcgctacaccgacctaccgcccacgagtgtcgcgtttgtgggcggcggcattgcggcgctgggcagctcattcgtcaaggtgccgctggcggtgtgcatccgcagcgtgcaggcgggcgtgtaccccaacgtgtttgcggccgcccgctccatcacgtcggcggccggcccccgcggcctgtttaccggctacctgcccacggtgctggaggacgtgcccgacatggccatcaagttcgccgcgtacgagagcatgcgacaggtgtgtgcaggcgggccagccagcgtctcgtcatgcgcagcgcatactgggttgctggttgcctggcttgatacgactagcgcctgaaagatgaaacgcgggcattgctgacctcccttgcacactttctccttcctgtgctcgccctgtccgcacaggtgcaccgcgccatgaacggcggtcggaacgccagcgtgcaggaggacttcgccatgggcgccattgcaggcgcactggctgctgctgcgaccacccccctggacgtgatcaagaccaacatgatgtgcaacgccgcgggccggccctccatggcctcggctgcgtccctggtgctgcagcagggcggtccaaaggcgttcttccggggcgtgggcgcccgcgcgctgagcaacggcgtcaacagcgccgtgttctttgtgttctttgaggccatccgcggggccatcgccaaccgcgtcaagagccacccagtgcagattgagagttga

SEQ ID NO: 32 - DNA, 2850 bp, Chlamydomonas reinhardtii
atgtgtctttctttcttcgtgttggacgcggctgaagggcctcgtttcctgctcgccttcaaccgcgacgagtatttcgacaggtaagagaccctgcgcagcgctcaagaagccgctagactcgccggcgacgcggaaagaacgagtcggacgccccacggttcaattgacatggcaggcgcacgcagccgctccacgagtggtcagatggcagcggcatcatcggcggccgtgacttggagggcaaaggaacatggctgggcgtcacgcggagcggacgcgttgcatttctgaccaacctgcgcagctccgaccctgtcgccccgcacacacacgccaacccctacacacacgccagccgcggcggcattaccaccgccttcctaacgggggacgcgtcgcccgcgaattttgcgcaggtgcggaatgagtataggcataccggtttcaccgcataccggttcgaccgcacgtaattgtgtgctgctaccgacaccgcgcaagtttgccttccgctccatctgctcgtgcccaaaccataacgcccgcacacatccagcagcacttgactcgcagtttgcatcctttacgctatataaatactcttaccatatgcacacctgtcgcaataacttgtcacagtctctggacgccgcaaacttccacggttttaacctggtccttgcggaactggccgggcccgcgcccagcctggtgtacacacacaacggcgcgctggtcaccagcagcacagccgagccggccgggaactgtaaccgcagcggcggcggtggtggctgcgacgttaatggcagcaatggcccggttggggcccgcgaggatggcaaggatggcaaggagcagggcggccttgcggcggggaagcggcggctgctcggggcgtctacgttgggtgcggggtttgcggcggcgccggcagacggcgctgctgcggatgtggaggtggcgctgggacagctggccgtgacagccgccgggcagagcagtccccgggcggaggcagcaggccccggggcagcagcagcgagggattcaacctcagcaggcggcggcgcgggcagctgcactcaaggcgcagaaggcgcagcaacgagcggcagcagcagcagggtgcaggcgcttaagtcaggtgtggtgtacggtgagtcgccaccaggcccaagcggcttggagctgcccggtcacagggacgtcaccagtaccaccaccaccaccacgacttcctgcaacctgcttctttcttttgcgttctgggtctcggtgttggaataccaccaccactgccggatgccgctgccattggtgggcctggaggtggggctcatggttgtgtttgcggccgccgctgctgctgctgctgctgcgtgcaggcgtcagcaacgggctgctgctggagtggcccaaggtggccagcggcgtggcggtgctgagtcagctgctgcccgagatacggcagggtgggtgcctgggtccagggtggggagttggccggctggccgcgcgggtccattgtgcgtgtgcgtgtgcgcgtgcgtgtgcgtgtgcgtgtgcgtgtgcgtgtgcgtgtgcatgctgtttcggcatgtttcatcgcgtggtggcaatgcagcacatgtgtctcttgctcggcgccagccccagctgcggcacaagctgccacacctacccacccaccccgccctgcaggccagccggtgccctggtcccgcctgttcattgagctgctgggggacgacacccgactggtgccgcccagctgcggccggcagcaggagggggcggcggaggaggcgggggcgcagcaccagggagccagcacaggtggcatcagcggcggcggcgtggccgcagcccaggtgagccgtgagggctggctgacccctagctggctgacccctagctggctgaccccctagctgactgggcgggtggctagacgactaggtaacggggcccctggctggatgggttggtgggtgggcccctggctgggtgggtgggtggacagctgggcaggctggcaggcacctctacacccctacacgccccacgtccgcggcgcaccaaccggctcatcagattctcaattgctcgtatcccaatacgacacccagcaacaggccgtggccccggctgacgaggtcgccgcgcacgtcggcagcggcgccgcagtgcacgtggacggccgacccatcgcaccagcaccggccggcgctggcgccggcgccggtgccggccacaaccgcggccacggccatggccacggcagcaatagcagcagcagcagcagcggctgtagcaatggagctggcgggaatggcggcggctgtagcagcgctgctggcggcggcggcgggggcggcggcggcgcgggtgacagctactttgagagggagctggagcacatcacgagcggccgctttgtggcggaggtggactcaccggtgggtgtggcagcgggacagtggggcagcagcgttaacagtgtttaaagcgttagcgtgcaggtcagggcaggtgacaagtacggtaataggttgttcagagttgtctggccatagcaagcacacggacagccccacacctgcccctcttagccgcaatccccggcccctgtgggtctctgctgcttggggcttggaactgactactacccgtactccttccctcccccgacctctgacttttgcacagtttggcaagtacggcactcggtcgcagacggcgttggtggtgtggctggacgggcgtgtggagatgcgggagcgggcgcgggagcccgacggcagctggcgcgagagcgcgctggacttcgccatttcgctgtag

SEQ ID NO: 33 - DNA, 994 bp, Chlamydomonas reinhardtii
atgtcttacttcgcacgatttacgcaggtaagcacccggccaatgcgaccaccagcgcctgggcgcagcgttttcggagatgtgcgctgaccgctatgtcgcatcgcaccgcaggcctcgtcgatgcggcatgcggcagctgcctggcgcgcaggtaagacacacaatcaaacccacgtcgctgaccttcgtcgcgcgggtgcagttctggggccctcggcgccgactggtgtgtggcacaccccacggccttgcacctgggcaaagctcgctcgtcgccagcctcctgcagcacgtgcgcacccccctccccgatcgctaggccttccacacaacctccctcacccaccgcctgtcaccgtaccaccaccaccaccattacccccaaacaggcgcgacgcagatgcatgcggcgcgtgtggcgatggccgcctcacagcggctggcgggcgggcccgtgttctccgcgccgccgccgccgccgcccagccccgcggccggcttctccagcagccccgccatgggcacctccttcgcggcctcgggccttctgggcagctccggcggcgcctgtgagtggctgggagggagggagggggtctggggcgcgtgtgggagggagggcctggggcgcgtatgggatggggtcaggcgtcggggcgggggggctgtggagtctgggagctactggcgggggccacagggggcggggggccggaccgagcgcagccgggttcctgggcttgatggtttggggggtcgcatgtcgtgactgtgtgtgtgaagcagggctacctcgaagcctagcgagcctgtctctgtgtgcgttgacctgctgtgtccgcgcgcgtcctggttttcccccgcccctgcagccacggccttggagggcagcgacggcactggagagggtaacagcctaggcggcgcctcccataaagaggccgttctagcggttacaaagcgatgtaggaaacgacgcaaacgcttttag

SEQ ID NO: 34 - DNA, 3855 bp, Chlamydomonas reinhardtii
atggtgagcagcgcaccatttcttttggcacttgtccccggctcatagtagtgacatgcaaagcgaacagtaataatacataaacacttatcattcgtagccgtccgccttctgggcatagcctctctgactctagcccgcccttcccttcacggtttacaggcgagtggaagctatgtaagccgctcaccgacaaccggcgcagccagctgggacgcgcccatgcactgccacacgccgagagcttcctgcagggccctggttggcccaaggagctcgaggacgcggccattgtgcaggtcagcggtgtgatgggccgccgtaagacgccgtaccgcaccgtacggtaccttgaccagagtccattgtgcatttgtgagcaggatctttgctactgtacgtagtcaataagttgtagggtgggaagcggaggcccgtcaaccaagtcttgttggcgtgctaccccccacgcaggccttcacccgctgccaccactccgaccccgaggccttctccatccccctgtacgccgcgggcgacgacaactccaagattgtggcacaggtgcgaacaagcacaacagactgcagcagcatgacataactccccgcccttctcgcccgcctctccactcccacccgtcggctctggccctcgtatgtcgtaacccccttcccttcccccgcaccccaggccttcggccgcgcccatacccatggcgccgtcgtgctcctgggctacagctggcgcgacggcccgcagcccggctggggcgatctgctcgcaaagctggtcaccgacttcgctgacggcgcctacacagcccacgccgccggccgcttcacgactgtggctgccgccaccgcctcctcccacgacgcggcggacgcggctgacatgggcagcgacggcaccgacaacaactcgccgtacgacttggactcgtcctacagccaggatctggatctggattcggtgctggagggcgctggcggcctgtccgacgaggcggcggaggtggtgcgccgcttcttgaccgccaccatgggataccctggctacccgggttacccgggttacccgggttacccgggctacccgggttaccctggcgtgccggcctaccccccgcccatctacatctcgccaccggtgggtgcggcagggggcttccggcagggcgggggcgcgttgtgagggaaaatggggatcggtggacacgtgagggactccatggggactgaggggcaaggcgaggtgccgggcccgctgcgtacgggaggaagggctctggagggggcgttgaggttgtttgaaatgcggttggcggcaatgaaatgatgctggggttgtatgaacaacaactggtccctgccagagacacggtttgatggtacccaatgtgctctctccctccgtgcagcctgccgtgctggactcgcccccgcccgccactgcgccatcgccttcgcccgcggagtcttccccgtctccttcaccctctccttccccttcgccctcgcccgtctacccctctccttccccttcgccctcgcccgtctacccctctccttccccttcgccctcgcccgtctacccctctccttctccttcgccctcgcccgtctaccccactccttctccttcgccctcgcccgtctacccctctccttctccttcgccctcgcccgtctacccctctccttctccctcgccctcgcccgtcgacccctctccttccccttcgccctcacccatcgacccctctccttccccctcgccctcgcccgtcgaccccgctccttccccctcgccctcacccgtcgacccctctccttccccttcgcccgtcgacccctcgccctctccttccccctcgccctctccctcgcccgtcgacccctcgccttccccctcgccccccgtgtacgccccgccgccctcgcccgcaccccctgcgcccgcccgtgttctgttcatggattttgccaacctccccgccactggtgtgcaggcacccaccaggtaggccgggcttgtatttgtgaagtgtatgtgtggtgtctccaaaccggacatgtgtgtgtgtgggggggggtggagcatgcggcgcgggctgagctgtatggcgagtcagcaacacaccaggcgtggcacgcggcactcgcaatacacatccgtgtgttacagagcacaaggatgaataagcgcaaaggccgcacgcaatgcagcaaaacgacagcaaacggatgtcgtgaaatgacctcgtgcgcgcgcgcgtgtgtgtgtgtgtgcacgacaggccggtggtgtggtacgacgatcccgacttcgacagcctgctggccgccagccccaacaacagcaagctgtggatggtgggtgtggggtcgggacttgggagggaagggaggagagggcgtgcgggtggttttgtgggatgcgcgaagccaggactggagagggggaggggcgcggggtaggtggcatgcgcccgcaagccggcgggatgcgtgctgcggtgcgtatggggctgctgggtgatggcagctagcggcggctaggctgggggtgtgccagctcgagtggcgcccatcaaggccagggcctgagccgcgttctgcgcgctgtgccgctgccgctactgcccttgctccccgcaggtgaagccggaccgggagccgtgtgttggctgcggccagtgcccccgggcctggtaccccaccaacaccaggtgaggggcggcagcgagcgcacttgcatgtggtcatggtgtggggtaataacgtcgggatctgcggagtgggctcgccgtaccaacccgcctccgctccatcctgtcactcccacatgcacacgccgagtctcccattttttgcttagtagcattattaacacacagttaattcgtctcttgcactgcccgcccgacagcgacaccaccaacggcttcaactacaccaccattgtggtttacttccgtgagccaatgctcatcaagagcgtgcgcctgaacgaggtctaccagccgggcggcgtgcagcaggtgggtgcagagggcatctgcacggccgctcagggagttacagcaacacggctaccaagccacctgacacccccgccctgacgcctccctcaaccccaacctctgcacctaaccccgcccccctcctcttcgtttgtcgccaaccccgcaaacagatcttcctgctgcagtggcccgccgtgcccgtgccgctcgtcttccccaacgccaccgcactcggccccgagtccgtcaagaagcaagacattgtgttcaacggccccgacacgaccaagacctgcccgggcgtgctgaatgtcgacgtgggcgtccagcgctccgcaatgaaggcacctgtgcgcaagggcttcacgcagaagcgcctgcagcgcggcctcaagaagcgtgccgtgggcggtgtgggaatcaccgtggcgctgccgctcccgagcgggccaggcggcagcaatggcaacggtaacggcaatggcaacggtcacgacaatggcaacaacggcaacggctggggcgcgcgccggcagctgcgcgccgctggcggcaacggcaacggcaacagtggtggtaatggcaacggcaacggcggcggtaatggcaacggtggcggtaacggcaacggcaacggcggtggtaatggcaacggtggcggtaatggcaacggcaacggcggcgatgactgggagcagctgctgacgactttcatcggtgacattcgcttcgatgggcgcgttctgtatcctcaggacccctcgatcttcgtgccttacgcgccgcccaagccgtacaacaagaagctcaagaacacggcgtaa

SEQ ID NO: 35 - DNA, 3779 bp, Chlamydomonas reinhardtii
atgtatgagcttggtcttgatatcgatggcaagccggcccatccggctgcaaccattgtgagcggcgacgactcgtcgctcgatggcatcgctctgagccgcgcgacgacaggtggtctgcttattgtggttggaagccctgccaaccttcataaaaccattggggcggcctttgatgtcggtgagtttgataaatgagcgaagggaaggcgaccaggcgcattcagcatccaacttcgcactgagccttaacaacgccggcagccatagctctgtaatcttaagcgcgctcttatggccgttgtatgcaatgagcatgtttcattgagcagccgccctacctaactccttggtgcgatcccatccttcaggctcggatggtcgccgctgcgactctacgtccaacggtggctcggtcacccacggcagcaggccgaggctgcacgctgccgccgctacgctcttcggctccgaggacgctctggatgcggagtggccccagacactcgaggcggtcgcggtcacgcactccattgccgcatgcaacgtcggcggcgccgtgacgcaggtcccgctttacttctcgcccagcgatggaagcatcgtggcggtggtgagttgcatggcacttgtctacacgttgtgtcaaagcagccgattgcgtcaattagtcctgtcttgcgtatttgggtcccgtcaccaacttgcttattagtcatcagggacacgctccccggcctccctcatctcacctccaccacccctcccctctcctcccctccaggccttcacctccgcctccccccgcaagcgcaccgtggtgtggctcggctacgactgggcggctgggcctcagacggcctggggtgccgtgctggccaaactcatcgacacgcacgccctgctgaccgccacctcctcggcggccgctgcctccctgtcctccgcatcctccgccactgccggagagcccaaggtcgtgcacatcaccaccacttcctcgtccgccgccgcctccaacaccggctgcggtagcggaacctgttcccacagccacctagtcatggccaccctggccgctgccgcttcgtcttccgccgcatccgcctctgccgcttcgtcttcagcctctacccttgcgcacaccggcggctccgagaccgagttcgcggctgatgcagccaaggatggtgatgacgctgccgcggagcccgtgttggtggatgacgcagccatggatgccgccctggactccatgccggatgctgtcagcgatctgtcagacggcgtcagcgaagtggtccgccgcatgatggcggccacaaccggcgccggcacgtacccggccccgccctccccggagcccgcctccccggcgcccccctccccggcgcccctgacgcccgcgccgccctcccctcggccgcccaagccccggaagtccccgccctcgccccccaccacgccgccccccctggcgcccccctcgcctccctcgccgcccgccccgccctcgccgccgcccccgctgccccccgggcttgctgccgaggtccagggttacaactccgacacgagcgccccgccgggcttcaacatcagcgacacactgtcggtgcagaacttcagccgcgacttctgtgagaatgtcaccagggccctggacccgcgcccggatgaggtgagccgagcactgacgtcgtagactcaatctaccacccggcacccaagtgacccaacctaaatgactcttgcccctgctcgctcgctcgctcgctcgctcgctcgctcgcagtgtgtggtgttcgacatcaagagccacggcggcgccacgcatcaccaccgcctgctgagcgaggcgggcgcgctgcgtgtgtggggccccgaggacctggcagcggagcacccggccctggccgccgccggcatgagccgcctggtgcacctgcgcacctacagcgtgggcgaggcggagctggcggcggtgagtctaccgcctgagcgcatgagcctgccttgtggtgtagatgacttgtgttgtggaggtttggcaccgtgacatgtgtgtgtgtgtgtgtgtgtgtgtgtgtgtgtgtgtgtgtgcatgctagctggctggggaggcagcggtttctccgtgaagtttcaagtgccttccgcagcgacggcggataggtggctcgtgcatcatgcgttaggaccggcgccgccaccactactcatcaccacgccacggcacaccaagacctgtgcttactccctagtccccatgcccctcgcccctcgcccctcgccttcctacctgcaggtgcgcgcctgggacctgtccgtgtcgctccccgtcaccgccctgccctcctcggtgggcggccgccgcagcctgcagcaaagcacccagaccatcaccctcgccttcgtggtcatctacctagtggaggtgcccctgccgccctcgccgccgccgcgggcgcccaacccgcccggcgtcatggagccgccctcgccgccgccctcgccgcccgccgcgccgccgcacccgccgcgctcgcctccgcggcctcccgtcaacctcaccgctcttgcctcagccgtgggcgccagcgcagtgtaccaggtcttcccgccgccgccctcgccgccctcaccgccctcgcccatgccacccagcccgccgccctcaccgcacccgccgccgctgccgctggcggaccgcatcacgtccgtccgtttctcccgcatggaggccgcgggcgcgcttggcagcaacaagtgagtcgctccggtgtgattctgatacattctgcacgcggctgcatgagcgtcgtgcccggcacactcagtcgcgtatatacacctgtgccgtctctgcgcatatacacacataaacacataaaggcacaacatgcggccgcacgcgcaccggatcggacccagcatgcgcactcaacacgcttcgctccctgtccctgtccctgctgccgctgtcaacaggcgtgtggtgtggtggaccgacggtgactttgagtcccagcgcaaggccgtgtggaacagcccgctcaacctggtgtggcgcggcaaggccgcctgcggcaagtgcggcgcctgcggccgcgcctggaagccgcgcggcgacaagttctcggtgcagctgtttttccgcgagccggtgcagcttgatgagatccgcatccgccaagtgtggcatgccggcgtcacggaggtgagcgcaggggttactcagctagggtggtgattgcgcgcgatgctagcttgttacttgctcattccccaacggtgcccttggtggtggctgacgagaatcttggcagcgtagcgctcgtcctcaacctgacacctcttccgccgcgcgccccgctcctcgcccgctctatctatcgtaggtgcggctgttggcttggccggccgtggacgccgtgaaccgcgtctccgacgtcttcctgggcgagccggtgctgcgccagaccgccgacaacaccacctgcaacacctggctcacggtagccatcccgcaggagcgcgccggcaccaaccagaccgtgcggcccatcggctcacaggacgccattccgccgaaactgcgcagcagcactgtgggcggcgtggtgatcaccacacgcacggcggccacggttcgtgccggcacctggatcgacgccgtggatttcagcgggcgtgtgctctatcccaacgacccggctgcgtatgccgcgtatgcgccgggcacgggtggcggtgcgaccattgggcgccggcggtag

SEQ ID NO: 36 - DNA, 3851 bp, Chlamydomonas reinhardtii
atggcgagcctggagcgcgtggcgagccaccgggctgcctcttgctcacaaatcattagcccagttcgttttggacgctggcagagcgtagtgcacgtctcgcggttggaccggcgtgtggccctgccctctcgcgtgctagtctccgcagcagctgctgatgtaccccagcaaggagcacccattacttcttctaccccttatgttcctactgcacatcaatcgattgacgaggacaacgtgttgacttcgttcattgccgagacgctcttgcccactcgccacgggaaatttcggctccgtggctacaagcattcggtaggtgttgaggacttccgcggcccatttagttgtcgttgctgcacgcgcacgagggtttaggcctgcgattgatcgtttggcgtgcccacgcagacggatggcggggcgaccttcaccgagcctaccgcgattgtgtccggcaaggttgaggggcaggaagacgtgagtttgggtcggggtcaagaaaaagggctgacgtggtgacgcgcgaatgttacgcgtctcgacgcacggacttcgcctcagcctgccagcacacgctcgcacagtgtagtgacaattgttcatgctgcgtacatcttgctgtaggtggcggtgcgcgtgcatgacgcctgcttcacgtcaggtaaggggcgcgacaacgtgcaggaccaacgtgcgagatggtgccactccgccagccccagccagcaactccattagctgtcccgctgggcacacatgtgcccgctcctgcactgcatcctccaccccagtttcgtcctcattctagctttagactgcacgtcccgcccgcctacccagcctcccctaccacttgctgtgcctaacatgctcttgacctcctcgtctttctgtgtggcctcctgtccacagaggtgctgggctcgctcaagtgcgactgcgcggagcaactggagctggcgctgcgcatgatccagggcgcgccgcccggcattgtgatttacctgcagcaggagggccgcggcatcggcctggccaacaagatcgccgcttactccttgcaggtgtgtgaacatttgtgcgtattggtgaaagcggctcgtgcgtggctgcagccgtgagccagctggaggatagtgcgagacagcgcgcagtagtggggcgtgggcaagccatgaggatggtatgtatgcgacgttacaggagggatacgcaggagcggtatgtgaatttccaaatgttgacgtctgttgggctgggctaggctgagttcgtgggctggactcaagacacggcatttcgccacggcggcaccccgggctgtacagcgggtcctgctactcgagacagtaccgagcgtacatacaaacatgcagtcaatccttttccctttcctctggttctcccagaagcgcccaacctgcctccggctgtgccatgctgacatgcacgctgccctctcgcaacaccgcccgcaggagcaaggcctggatacggtggacgccaaccgggcgctggggctgccggacgactgccgcgagtacacctcggtgcgcaacatgcttcaggacatgggcgtcaagagcatccggctcatcgtgagtggggcgcgggatgggcggggcggagggggcgagtggccggccggtgggacagctagtagggtggggcggagtggaggggcgagtggccggtggggcggctggtggggtggggcgattggggagtacgcggggttgcggagtgactgagatgttaggaagcgcgctggcagccgccgcatttgtgtgcgtgtggagcgggtgcggttggcggcgcaaagcggccagggggtgtgggaggggaggctaacatgcggtgtggcaggtggcaggcaaacgtggtgacctacgcttatcatggagggatgagggcactcgggcgcgcgcacggcatgggctctgtggatggccaccgtttggttgaactgtaagcaccagcagcacggcttgcactgcggaggaacagcatcgggcccattttgattgcctcaggccgtcaggccaggatcaccttggcctcggtcctctcgcctctcggtctcaaaccctgaaaatgcgcccgctctctcggctaccgcaacctgcatgcgtgcgccagtttggccccatgttgaagccagtcctcgtaaccacccaccccggcccccagtcctgacactccgcgcctgacactccgcgccacgccgcgccgcgcagaccaacaacccgcgcaagatcaacacgctcaccaagctgggcatccaggtcaacggccgcatcccctgcctggtggcggcgggtgcgtacaaccaggtgcgcgcggcacagcatgcgggcgggcggggcgattgcggggcggtcgcggaaggagcgggtgccgggggcggggctggccaatgcggtaaaggcgagatgaggcgaggagtgggctctgacgcacggctttaacgcctcacgtgtcattattttgtgtccacagccaacacaccaccagaatcaccaattatgccacccatgcaacaaactgtcaacatcatcttggcttatttcatcatgcatagaatcccacccatgcgccaccaccccaaccgccacaaccgcctctgccgcctcagggctacctcgaggccaagcgcgaccgcatggctcacatgctgcccgaggaggaggcgctgggcagctcgctgggcggacccgagccggcggcggcggcggcgcagcgccccaacggcgcgggtgtggaggcgggtgagctcaacggcgacttctgcttctgggaccacagcggcgagcccacgcaggtgagaggcgggagaggctgggtgggtgggtgggtgggtgggtgctggagcaggggcgcgggttggggggcgcaggggctggagagggcaggggctgagggacgcagaggcggcgggggcaaacgggcaggcatggagggggtggcgggaggaaggcgtgaaggcaggggcgcggcgcgtgttgtttgcggcgtacgttcgtgtgtcgcggcagggcggggtgggccacgtgtgttcgcatgtcgcgagtgcagacgcacacacgcacacgcgcactcacgcaggaacgggacatgacggggcaggtggcgcgtgacgggagtggatcgcggggcgggcggcgcagtaccggcggtagcacaagcggcacaagtaccggaggtagcagcagcacgggcgccacgcccacattgcaggggcctcctgcggcgcggcgggcgcaggtgccgcggcagcgcccgcgggaggccgtggcagtgcgttcgatggccgatgactctagcggcgcaggcagcagcagcggcggtgcggccggtggcgcagcggcggcgcgggactcgtgatttaccctaggcatgaagattgctgaccgcgagaggcacctatctttaaggtacctccagcatgcacatggaaggtgtttaggaaacctgcgcggtgatgtgcatcgtggtgctgcggatcgtgacgcgttgtacacgcgtctgcacctcagcgctcgagagtcgcggccctgcagcattttggcaatgcggagtgcgaatcgacagtaaagcgcgcaccgtatccacatgcacattccgcaatacgcttgtctgggtccccgcggccgcttcctgaactgtgtggtgcctatcgccgccgctgtgccccctgtgtgctctcacaggctgtcgctacggtgtacgccaagggtggtatggacctgccgcaggggctagcacatggcgacaacgggcgtgtggtgccggtggcggcagcgcccgcgggcagcagcagcggcagcgatgcgggctcgtcgtga

SEQ ID NO: 37 - DNA, 981 bp, Chlamydomonas reinhardtii
atggcggagctgcacgtcatcgggcaaatccagggtgctatcggcttccccagccagaacctgttctgcaaggtatggccatgcggtaggctattttgacaacaaggggcgcaggggtatcggggagtggttcgtggcacgcagtgggctaagcctgccacggtccgcggcagcacattcgacgacctcgtcccttgactgacccctgctgcaattgcttgcgataccctagtggggagtcgctgcagggcgaagctgggagctactagagggtttggactctgggcagacgcaactcgacctggcaccagagggggagccggtcgtgtgggcccatccacttgacctccactacgcatgtcgcggcctagccggctggccaaagctatacttccaagtctggagccaggacgtacatggccgaaatgacatatgtaagttgcgccgctggttggcacttactctgaggtcaaacatatggtggcagtcccattgctcagtgacacttttccacgtcgggggcacaggcgggtacggcttttgccacgtgccgacggcgccggggcaatacgagattgaatgccccacgtggataccggaggtgagcgtaccaccttcgggcgtatgcagggatgcttggtgcagctgtcctgcctgcaccagcactacctatatgcgcgcggctcgtggttgggctcgggtcatgacggcaccaggctgggtcctctgctccctgtgaccctaaaccggccctaatcttaattccccatttctcccaaacccatctgtctctgtcagggcactgcgggcgagcgcattgcggcgttcttcctgggcggcaatccccggctcaagtacgaggaggtggtgtacacgcccggagatcgcttccgcctcaacaccgtgtcggcggggttggtgcaggtgcagctgggcgtcattgtcaaggactttgagcgcaaccacgtgcactttgggtga

SEQ ID NO: 38 - DNA, 4277 bp, Chlamydomonas reinhardtii
atgcttcacatcctagagaagacagaggaggggcgtaacgctctgcaggtgagaccgccttggacgtctgacagtcgtgggggcgaacccagcccacaactgccagacacgccgcaccagcgcggttcgtagcggtgcgaagagcccctgacaagcccaacccacatcatgtttctgcaaccacacaccagacacgaatccctcatcccccaaagtgaactgaagggggccctctttgtcctgctgccgcaataccccttattgtgtgtcctcaggagatgctggggccgcttcagcacctgcaatacctgcagcgcacagttcggcagcacgagttggatctcgactcgctcagccgaaatgtagacgagcggccctgggacccctacacagcctttgggctgcgctaccacccgccccacagcggcagcggcagcagcagcagcagctcgccgcaacgggcgcccagcaagcacgccagcaacaaacaccaccacaagtcggggtcgggttctacacacggcagcttcgccgcagctgccgcggcagccaatgcggcggcggaggcggcgaaggtggcggcggacgtggcggcggagatggcggcacgcggtcgcgccctgcacaaggcagaggcggcggacgtggcttcagggggtgacggcagtagcaagagtgatgcaagcggcagtagcagcaataacagagagggtcagaagagcggcggaaaggacagcagtaaaagcagcagtagcagcagcagcagcagcagcagcagtggtagtggcgggacgagccacagctacccgcgcttgaggcttagagaaaaggtgcggcgtgtgcggtgccgtggcgagggcgacgggatgtggggctggggttggaaaagaggcgaagcggaaagcagctggttgcggcgggcgcagatgggtaggtggcaaattcactgcagtatatgaggtgtttgccgaacaagggctgggccgtttgatggccagcaaaacggtatgtgtgttgtatgtggggtgggggttggggtgggggtgcgcaacggtggggctcgggaactgtgcattggctaccatacccagtactcacgcagatatgacgtcatcgctcctgacaggtggtgcgaggcagcaagcacccggaggagctgcaggtgcgacacagggggccgggggctgcgggaccaggggttggggtttggggtttggggagaaacttgtttttgttgttcgtggtgaaggtctggcggtggcatcgcgtcatggcggcatttgctcggtcccacaaagctgggcatgctatggaggtgccgctgtgatcgatgtacaacgcgcgtgtctgtgcagactgagctgacacggcgcaaggaggcggtggcggcggaggcggaggcgctacagcccagagtgggggccatgctggagcggctcagggtgcgtgtcagcgtgtgccttttggtatgcatgtgtggcggtgtgggtgcagcgccttgcggcgtggggggttggcaatgcgcaccagcggcggcctcgcctgcccctgacacatatctgacataacacacgcaaacgcactcaaccacagggcttgctgcaggccgcggccaacagcagcggcctcgtgccaggcaacgcaactgcagaaacgcaactagcagcaggcgccggcaccgccgccggcgaccccaacgacattgttgcggatcccaacgacctggatctgtacgagctgctactgccgcgctgcgtcctggcgcgcctggatccaatcaactatgtgtcgtacccggcgcggcccttcgtgtccatcgtactgtcgtactcgggccggcggctgccgcacgttctgtacgaggttgcggagccgttgttggcgtgcgccgccggaagggacctgccgccgtggcctggtccggaggacggcagtggcggcggcggcggtgtcggcggcggcggtgctgccgccgccggggatggtagtagtggtggcggcggcggcgcggctggtggcaaagggccgttgaacgagccagtgtttttgccactgcctttagagatcctagtggcatttgacgaggtcagtgaggcggcgggctgggcggcggcggcggcggacagcggtggccgcatcatcccggtcttccggcccggcgtggcagacgtcagcgtcagtggcagtagcaacggcactagcggcagtagcaagactggcagcagcagcaacaggggcacaggccggagtgctgggagtccgccgccgctggtgcactgggccaatcgggtggcgcaactggctcagggcgagatactggtggtggtgcaggtgcgggcgcgatgcaaggtcttaggcagtgcgggaggtcgggtgcgagaaagggaggggttgaggggcggtagctgcgacaaagcccagagcacctcgagctgcttgcatgtttgccgcgtgttcgctgcacgctggcgtcgcgtcaccctgtgcattcatcacacaatctggcgccgcacgctcgttgtcgtctgcggctcacaggacggcgactcgctcctctcgccgcttggtcccgagggtgctagcggtggcaccggcagtagcaccagcgcgcgtgtgtgctcctggctgcacgtggcgctgcggacttttgaggcctggccgcagctgggcgcgctgggctcgggcgcctacgtcatggactggcaccccgccgccatcaaccggggacagcacttctggtgagggcgggcggcgggcggcgggcaggggtttgcagtgggaacgcagggaggttgcagtgggaagggaggttgcagtgggaaggcagggagggtgcaggtacgggtgggtggagcgggattgcccgggtcagcaacgcacctggcgggcgcatactgcccgtggtccctgtggtccatgggccaagtgcactgccagcagccaaccccaaaggctacagcacagtccgcgctctgcagtctgcactcctttcaatctctctggttctttgccgttgctgcaagtcttgcatgcctacaacttgcggccgccacagggataaggagcggcggctgccgctgcaatttgtggccgcggcactggccacgccgcaggcggcggagccgcgaggcggcgccgagctgccggcggcaccggtggccgtaaggcgggcggcgtggaggcagctcgggggcttggacgcggggctgggggctgccgctgcgtgtggcgcgtgtgcatggctggacctgtccacacgcctgtggctgggtggctggcaggtgcgcgtgggcggtgcatggagtgcacggggtgcaatggggcacggggctggtgaatgcttgcatgtcatgcgccttattgacgaacgcccttgcaccgttgaactgtattctgtattcctgcttaccagcaactccccactgctcgataccgtatgttcttctaatccacaggtggcgcagctgcccctagacctgggcagttcctcgcctgctgccaattcgctgctgctgcccctggacgcccagaggcgcaacctgctcactgcggccgcccccgcgcccgacgcatccgggccagcgcaccggggcacagcagcagtggctgcggagggcgtcggcgacgccgaggcccgggctgggtccaggggccacggcgccggtggtgctggtgcaccggaggccgcggcgtggccccgcagcttggcggcaacaggcgtggcgccagcgggctgggtagcagaggatgtggcgtggtgtgagcggccggagctggcggcgcaccggggccggctggagggcgtgtgcgcgcggctgctgcagctgcggtacggcgcctcgccgtactggcacgacggggcggtcggcccgggcaatgaggatgcaacggctcagggtgagcagcgggctgctgctgctgctgctggggctgcgggcagcattggcggcagtagctttgaagcgggtgagctagggacagggaaagggacagcggctgggataccgactgccgctcgcgcggttgtcggggccgaggaggctggagcggaggacggtgcggagcccggcccgcagggtcggcggagcttgggctcaaggagggcgggctggccggcggcctggttcctgggcagtgacgtgcacgtgcttgtcacggagcaggtgaggcagctgaacctgctgtcgcccctgttccccctgcttgggtggccgggcttgggctccgcctgccctttcggtgcggctggatgccatgagccgcacgcaactgtttaa

SEQ ID NO: 39 - DNA, 5513 bp, Chlamydomonas reinhardtii
atgggcaagcgacggcgtgaggacgctgaggctgaagagcctgcagctgaagccgcggagccgcagcctgaggatgtggccgccgatactggcggcgcggcgcaggacgccggcgcctacgagggcggcgaggagggtgagggaggccgttatggacgccgcaatcggtcgcaagttaatcccgagacattgacgtacctggaggaggtcgtcggccatttccaaaccctggtcgacgatgaggagcgatcgctgctcgtcggcaacgtgcttgacgagctggcaggcaaggaggtcaaggtcggcagcgacccagtgtgcagccgtcacgtggagacgcttatggcttcggcacaagcggggcagctgctgcgcttcctgacctccgtgtcggacgtcgacggcctgttcacgcttgtaagcaagtgagtgagtaccgcaagggctatctcgcgtcagtgacttgagataggagggaagatagcttgtgtgggaagatcaagaggatgcggtgacgggcacgtaagcggtggcccaaacccggccgccgccccacacctcaacgtgacacccctctcagaccccttccccctgcctcctgacgccacgcaccgcgcctgcagccccttcggctcccacgtggtcgagaagctgctggtgcgagtggagagccagctggacggcatgagcagtgaggagtacgacgagtttgtgcgggtgagtcgcacccgggccctgccagtgccctgtgccaggtggcgtgcagggctgcagggctgtgcgcggcgccaagcacttcgcgcgaccgggctgctattacctgctatccctatcgtggatctagttgctcacgtcgttgtcatggacggttttccctgtgcccggttcctcttaccccgccttccccgtgtcgccgtcgcctgaccaccttatccatgcctgcacctccgcccccctccccaccaccgtacaggtgatgacgctgctggtcgacgcaatctgcccgcatctgtacgactacgccaccgaccgcttcgccacgcacgttgtgcgccgcctgctgtgcctggcggcggggcgcaacgtcctgccgcccgccggcaagcccaagggcaagcagcagcaggaccagtcgctgccggggctggagaacaaggtgagagggctcggtgaggggcgcatgtgtgccaggaggggcgggaggtgagtggtgtaggaggaggtgatgaggcggactttgggcggaggcgacgtggctagcactgcgtggtgagcggcacatggccagtgggatgcaccgccctgcaagtgcgtttgcttgaactacttgtcctgccttcaagctgaccctgaaggtcgtgtgcatgctgaccaaatcccaccccagcggcgcaaaggcgaggtgctgggcgggctcgctgccaagctgggacccggcaccggcggctcgggcggcggcggcggccacggtgggcatggcagcaaggcggcggcgatggcggcggagctgctgggggcgggtgcggacgaggctccaccggcgcggttgccggagctggtgtccaagctggttggcgcggcctgcagcgacgacctggtgggggcggccatgggcgagatggtgtaccacccctacgcctgcccgctgctgcaggcgctgctgcgcgcggccgcaagcgaccggtgagacgaggcgaggcgtggggcggcgatgtggggcgtgcggcggcgaggcgttctgtgtatgggggtgattgtgtggagtgcagggcagggagcacgcgtcccataattatgtgtgtgcgtgtgcgtgtgtgtgagagagagtgattgcgtgctctcacttgccttccatctcccggtctccccatcttcttcgtgcccctcttttgcctgtcctgctgccctgcagcaagctgctccgcgggctggtgcctgtgctgctgggcgcaaccgccttcaacgacagcgccaagggcggcgcgggggcggtgctggagggctgccgggacgaggaggtggcggcgctgtttgtggaccccaccgcctcacacctggtggaggcgctgctgcaggtgcgtgtgtttggggttcttgtgtgggatgtgtgtttaggcgtgtgtgtgtgcgtgtaggcactgcatgcatgccacgacagtaatgctggccatgattgtaatttgcctactcgataacccatgagcttcaagtagattgagtctaatactgagccacgcattcgacggtcaacgcatctgtttgaatcatacgcactgcaccattcagcatgttgagacatggcgttggcgttggttgggtatggcgaggatgatttttgcctactcgataacccatgagttttaagtagattgagtctaattctgagccttattccgccaaccgccaaatgcaattacaaacgcataccgagttacaacatgcatgcacacacacgcacgcacgcgcgcacacgcacacacgcacactgcatcggtctagcctccccctgtcctatactccatgccccgtctcatcatctctaacctccaaaccacaattcgaattcaaacctgcaacaccaggttctgcccaagtccatggcggaggagttcatcaagcgcttcatgacgccgcgtcttgccgacctggcgcaccacccctcggctaatttcacgctgcaggccgcgctggcggcggcgcccagcaaggacatggtgagcggcttggccccttgcgcgagatcgagtacatttcggctctgactgtgtagttcgcgtgcccatatcatcgacgcccatgaccatgtgtcaagacccacaaccaagcaccaaaccacttcgtccaaccacctctcacaaacccccttacaaccacccccgcgcaggccaaggcgttgtatgagggcctgtccggcctgctgcccgacctgctgcgcaagcgccgcagcggcgtggtggcggcgctggcggcctgcctgggccggcacggcgtgtgccagcgggagctgtgcacggcgctgggctcggcgctggcggggctgccgcaatgggcacacctcaagggtgaggggggtggccgcgggtgaaggggggggcgggatgtggaggcggcttggataccggtacttggattctggtgctcagcaccgcaggcaggctggtgtgcgtcttcccactcggttgctctttgccgtgcgcctttgtgggcctttttgcacacaacaacgaaatggctcggtatcgtactcccttgtcccatacagtggtcaagggagttggttaaccgcgcaatataatctcattttcacaccacattgccgcttctccggcacagcgtacgcgtgacacacgccgctacgtatcctaaccctagtcatccaccgctcagtgccccaccttcgctcattcacccatcctcctcacagcctctctcccccacctccaccgcccacacctcctccttccccacctcctccacctcgcaggcgacgccgcgctggctcccgccttgctctgcctggactcggtggcggtggtgggcgccaacgagcccttcgccggcgcgctggcggccggcagcggcggcgacaaccgcgcgccgcggctttcggcagtgggctgcagcatcctgatccaggtgctgcgctacggccagggcgcatgccgcgccttcacagacagcgtggcggggctgcagccgtacgacgccgcccggtgagtgcttcggttggtcagggtgagggcctgaagggccgcctccccgcacaaacctgtgattaaactactccgtggacggctgccctcattcgtcttgcgtggacggctaccctcacctctctctcgcgcgcacacgcacacacgcatatccattccttcctcagtgccttttccaacacgctttttccaacacgctttttccaacacgcttttccaacaagcgctctctctcttatcacagggtgggcgccgaccccagcggcagccgcgtgctggaggcgctgctggagggcaacgcgcctgccaaggttaaggcgggcctgctggcgcggctggcgggccactgggagctggtggccagcaccggctcgggcagcttcctggtggaggcagcctaccgctccgcggtgaggaaagaggggagagcaagtgctctgtgtgtgtgtgtgtgtgtgtgtgtgtgtgtgtgtgtgtgtgtgtgtgtgtgtgtgtgtgtgtgttgcttaatgcgcacgaggaagggaaacatacgggtgtgttaaacaaaagcaaacggaacaattccgccatacgggtgtgtgtgcctcttgtgcgcgtgtgcgttctgccgtgtgcatacgcgtgttccttacctaatcttttcgccgcacgctccgcgcgcccgcacctgcaggatgtggatgtcaaggaggccattgcgggccggctggcgtctgccgccaagcaactcgagggcacacactgggggccgcagctgatgagcaaggtgaggaggcggaggggggtcaaggcatcggggtcgacgtgtgtgacgtacggcggggtgcctcgtgtgtttgggggctaggggctcgcattaggtctctcagggttcctctcctcagggctccagtggcatgcggaacagcgtgttgggtagcggtacttggattctggtgctcagcaccgcaggcaggctggtgtgcgtcttcccactcggttgctctttgccgtgcgcctttgtgggcctttttgcacacaacaacgaaatggctcggtatcgtactcccttgtcccatacagtggtcaagggagttggttaaccgcgcaatatagtctcctttccataccacattgccgcttctccgggacagcataaggcattatgattgcatctttccatgctgcatttccatgctgcatttccacgatttggtgaactaggggctggccagacgcttactgacatgacgcgatcctttcgcccctgccgtggctccgcaggtgggcgcgagtgcttacgcacgcgaccccgagcagtggcggcggcacgctgcctcggcttccaagaccctggacgcctttgcaaagatgttcggtgacgggcctgcgggtggcgccggcaagggcgcgaagggcaaggccgagcagcaccaacacaagggcagctcgcaaaagggcgaggaggaggcagaggaggcggctgcggcgggcccgtcagggagagacgccgagcttgaagcggggcttgggaagaagaagaaggacaagaaggataaaaagaagcggaaaggggaggagggggacgggcctgacgggcaagccggccgaagcgggcaaggggatgccggcgccgaggaggagacggcggaggtggaggagcaggatgcgacggccaatcaagggaagaagaaaaagcggaaggcaagggaggtggaggctgccgaagaggcgggcggtgcggcggatggcgggacacaagctgcggcctcagaggtcaagagggcaaaaaagcaaaagaagaaggacaagcagtag

SEQ ID NO: 40 - DNA, 402 bp, Chlamydomonas reinhardtii
atgcccgcgagctccgagggcagcagcaccagccggagcaggacagggagcaggagcaggagcagaagccaccgaaactccaggaagcagcgccctcctagcgctgttgcggacgggcgctggctcgccctggggctcagcgtggggctgggctgcatcggcgtggggctgggctgcatcggcgtggggctgggctgcggcctcaagagtggcctgcgcagcatcggcggtgggctgcgtagcatcggcggtgggctgcgtgggctgggcagggaatccttcgccaaggaaggcagcacccttaaggatgcgtccgcgagttttgggtccaacttcgggtccaactttggagttaactttggggccaacttcggcaccaaaatgcgagaagacgagaactga

SEQ ID NO: 41 - DNA, 1899 bp, Chlamydomonas reinhardtii
atgcagtgtgcaaggaagtcgatctcgacgagcactactcgcaaggtgtgcaagcggatgttgccttgctggtcatcgctgggttcgctgccacaaaatttgcgcttcagcgcttgttcagtcacacctgtggtatgctcttcgcaggctttcggcgccagccgtggctcggccgtcgtagtaaaggcggtccacaggtgtgccatggcggggggcgctggggtgggggttggctgtctccagacagctcacgatcacagctcggtattctgtcgccgctcgggagggtgagccacagtgaggggcagcgggttgcccgggctggcgctgtgagctggccttggaaaagccaggggaaaagccgctcccgtcgttggcgtcgaaggcgtcggacacagctagatggctcagggatacgaaatcagcgggtgaggctcgccacgactgcttgtgaagatacaaatctcacatcacggcctcacacatgtcacccaccctcatctcgccacgccacgtggtgtcacgcgccacctcttccagcagggaggcccccgcggccgccgacgtgccccgccgctcgctgctgctctcctcgctggcggccgcgggcgccgccgccgccacctcgctgctggctgcgccgctgcccgccgccgccgccgacccggtcacggacttcctccgcggctacacgcggccggaggtggggctgcaggaggcggtggtgatcctgatggacgcgcgcagcacactcaaggagatcgaggtgggcagtccgggacacgcggcattggccgcgcctgcgttggtggggtcgttcatggacacatgtatgttggccctacagctgtccgcctcaggaatactggtacttgtcatttgttgtgggcgcatcggaaggcggacaaccgggagccgtgcacctcacgcagtatatggtaccggacacaaaccccggacccattccccggacccattcccacaggccctggctgccactcccgaggacagcgaggagcgcttccgcgcgcgcgccctgtggccgtccttcgccaagcgcctgcgcgccgtggcggaggcggcgccggtggcggtggcggcggtcacgggcgcggcggacaaggaggagacgctgggggagatgtacggcggcaaggcgggcggcgcgggggtgagtgcgacactccaatgagggacgggcgcgaggagaaggagtggcgcaaggagtgaggggagtgcgccgggccagacgacgcgtgagatagtcacatagagggcggagctcgtcggtggagctgcagtgcacatgatgtacaccctccccttgtttgccaaaattgtttgccatctactggggtttggggatcagctgcacctcacgggacttcaccaacctgccttaacactgtcccatcgcacacccatgcctccttccctccctgcccttgcctccctcctaggccgctgacgccgtgtacgcggctctgggccgggtgctcaccatcagcggccgcaccatccggcccgaggcgcaggccggacccgaggcggcggcggacgcggaggcagccatcagcggcttcctgggcaaggtgtggccgtgcgtgtgcgtgtgcatgtatttgtgtgtgtgtgtgtgtgtgtgtgtgtgtgtgtgttaagaacgaaacgagtgtggccctgctgtgtgcggtgtgtcaacacgtgcgagtggtgtgcatgctgtgtggcttctgctgcggcactggcctactcctcactgtccctacgccctcctgcctcccctttcccctttccctgtcccctgtcccctttccctgcctgctgcagctgccggcaccgctgctggacgaggcgcaggccttccgcgtggagcgggccaaggcggcggctgcgtga

SEQ ID NO: 42 - DNA, 1120 bp, Chlamydomonas reinhardtii
atggccccctcagggaaaacatacggtgtcgctgacctgaagcagcacacgacagaaaagtcgtgctggctagttgtacacgggaaggtttacgatgtgaccgagttcctggaggagcacccaggtgcggagctgcgcgcatcggcgtaaaggactgggtcacctggagctggagacttatttacgtggcgctatgctaggttggactgaccaggtactgttgtcgactgctctctggctcgcgctgcaggcgggtatgacatcatcctcacctcgacgggtgagcctttgatgacggctgcagattcagctttgtatgctatagctgtaaactagggattgccggccttagcgatcaagccgcggggtgcgcttggcgccatcggctcgcctttcaacccgcaagcgttgcgggttggatgcttgcaaggggatgtggtctcgatggtgatgctcgcaaaggggatgcctcggaagagtttctgtgcaccgttctgaaagtggtccttgggtcgcaggcaaggatgccacccaagattttgaggagattgggcacagcaactctgcaaagaagcttctggagaagtacgtgatcggagagtttgaggtgcgttctccatcatggacagcagcacaacagcggccgagttggtaggggtgaacctggggtggtagcgtgcgttggagcggaggcgcgattggctactaggtaaggggatggagcagcgcttgggctgactgtggttggccagtctgcttaagcttgaggaacttagcaacggcaggtcctgggaatgcggatgtccaacaggccgcgcccaagggacgagaggtagaggcggtgtatgtgtttttccacggcgcagctgttgcaaacaggtgcattcgcttggacaacgcactgccttgacacccaccatgtcctacacatccccgcacacagggtggcgacagcgctcccgccgtggccaaggtgcctccgcagagcgccaacgcggcgaagcagcagcccgctaagagtgcggcgacgcgaacattccacgtcatcctcccactgctcatactggcgctggcgctggcgctcaacttctacatgatgagccagaagaagtctgcatga

SEQ ID NO: 43 - DNA, 3047 bp, Chlamydomonas reinhardtii
atgaaggtcatcagctataacatattagctccgaagtatgcagggtaagaggaggggatggctcgtgcgctggcggggcgcaataccctttgcaacacccgtcatgacgaggcaggggcacgggccgcgaaaccggggagtaatgcagccgtcatctgttagggggccacgcgtgggcagcgagctcgcacgggtgtggagctgctgcacccaaaccgcagcccttgcgcttctccatcccccaccctgctcccccaggtacaacaactactgcccgccgcagctgctggcgtgggcataccggcgggagctggtgctgcaggagctgagccactacggggcggacttggtggcgctgcaggtcagagcgcttgtgttgaggggcggtggcatgttctgctgctgtatgtgggatgggcagcctgtgtacggcagtacggcgtgcagcccagcatcatgctggcggggaagcgcattccaatgctggcacctgacaccagacagcgggctgaatgacaccaacccgccccctggcgccccaccatgccccgcaccccaggagtgtgacgaggccttctacggcgcagagctgggcggctggatggcggcggcgggcatgcagggcagcttcctgccgcggccggtgcggcggagggcaggaggggcggcaggactgcaaggaggggtggtgcggatgcaaaagcatcagggagaggacagcacagctgacggtgtgtgacgtttgttaccggcaccccggataacttgtggggcgcccctgcacctactagtgctgcatccgcggccggtggctgcaggtgggcccggtgccgggtcccacggagggcattgcggtgctgtggcgctccgcggcgctggagctggtggcgccgccgcgcagcctgctgtactcggagctggggccggaggcggcggggctgccggcagaggtggcaggtgcgggcggcggcaacagctggggcgccgcggtggggcgcgagcgcatttgttgagggcagtgcgcgtgtgtgcgcgagctgcgggtgcccccgctgtgggggcgcggcggccgcctgcccgcccgcgcggtgccggcatggctcgacagtgtggaccacggcaataccgggatccaacggctgcaggacacgcggtgtggtgtggtgttgcacggccgcaggcacgcagccgtggctgaagctgcgggagctgggcgagggcgcggtgatggcgctgctgcggcaccggggctcgggccgcctgctgctgttctgctgcacacacctgttctggaaccccgtgttcccagatgtcaaggcactgcaggtgcggctgctgctatggctgctgcatggcgtagtgaattgcaagtagaatgagactcaaaacttgacagggggtcctgatgccacccggtgccggtgtagcggggcctgttgagcacgcactgccggtgccgtgcatgcggcgtcacgcgtccgacatgagttgttgatgtaccacatcgctgcgcccgccgcccccaggccgcgttgctgtgtgccgagctggccgcgtacagccggcaggcggcggcccagcagcagcaggaggaggtggggccggtgccggtggtgctgtgcggcgacttcaacagcctggcagagaagcggctgccggacggcttcgaccctcaggtgcgcggcgtccaccgtggatgtgcatgtggtgaatgtgcgtgtgccggagagcacaaggaaagtaccatgcaggactgtgtatgcaatgcgatgcgacgcttgcggtattacggtatcttccataggattccctgcaccgacctgccgagtcgagttatcatactaaccctgatatcctgttactccaatctacccaacctgaggcgtgtgctcatacgcgcgggaggacttcttggacgttggctgacttgctgagtgcccccgcccctcccgcacatgcacacgtacgcacacatgtacgcctttcgtttcccgtaaggcaccaccgacaccaacagcccaacgcttctggaacggaaacgcgcgtgccgtcaccacgcagcatgcgcgcatcgcccagcgcccccccacatgcatcccggtccactccaggccacttgcgttcaccgccatgagcgtccacccaagccccgctgccatcaccacatcccccgcgcacccacatcatggccttgtcccgatgtccccgtgtcaggtgccggagggcgggcggttggtcagtggcgtgtacgaactcttgtcgggcggcgccctggcccccgagcaccccgaccacccgcacagccgcgtgtggcagccggggacgatggcgcgcaccgtcacgcccgccggcggcgagggagcgccgcgcttcccggcgctgccgctcagctcgtccgggttgcggctaggcagcctgaacgcgctggcattcgggcggtgagcaggctggttgcgtgtgggcacatgtttgtgccaagccggacagctgccagacggctgccagacggaatcagcatgaagtagcactgtttgcgccgcacgccactgtgatcaaggcgatcgagcaaaccgcgtcagttgggacccccgcgctgcatccccgcccgagatgctcaacaccacaaggcctcaacgcccccgtgtgtgccactgccccaactgcaccgcgcacccagggagccgcccgtgaccaaccgcaccgcccacttcgcgggctgtctggactacgtgtggctcagccagccccacctgcaggtggcggcggcgctggccctgccgtacgaggacggcggcagcccgccgctcacggggcccgccgccgccgacgcacctgcgggcgctgctggggcgcaggggcccggggaaaggggggaaactggggttacggggccaggggcgggggcgagggtgggggtgggggtgggcgctgcgcggccgggcacgtggcgggacccgctggctgacgtggccatggtggcggtgccggaccagcaataccccagcgaccacttggcggtgggcggcgaggtggtgctggtggtgtag

SEQ ID NO: 44 - DNA, 5034 bp, Chlamydomonas reinhardtii
atggcggatggcggcgccgccggccccaccagccgccgcccgcgcctggatgttgacacgtggaccgttcagctagaggagctgctggcgctgcaatcggtgtacgaggatgacatcaggtgggggggcgtggggttggttgggaggtgggatggtgggctggatggggaggaggtgggggaagtagggggaggtggggaaggatgcaactaggttggtaccttgccatgcggccgccaagcgctgccctgctcacacaccaccgccggtggcttccaccctgcagcattcttgcggcgccgggggctggcgcggccggcgacggccccagctgcagcgacggcagcggcgcgagcagtgccccggcgggcccgctgagcgccgaggagctgcttgcggcggggccgccacccgagctgctgctgccgccggacgaggcagagggcgctgactctgagggcggcggcagtagcagcagctgtgggtgcttcgtggtggaggcactggtgcacgtggacatgccggagggagggctgcagttgctgattgagatgccacccatgcggctgcagcagctacagccgcagccgccgcagcagttggcgcctgtagcagcgcctgtgacagccacgggcaccgctgccaacgcaggctctagcgctacagtcatcgcggcagccgcaggggcggcagtagccaatggcggcggcatgtctggcgctgggaagggcgccaatggcgcagcaggcggcggcggcggcggtcgcggcaggggccgcggtgacgccagcgcaaacggcacctcgcccgacaagggcgggggccgtggtcaacagggtaggggcagcagccggggcagcggccgcggcagtgggcgcttgcgcagcggtgacgcgcacgccacctcctcccagacaccttcaccgccgtccaagcaccagccggcggtcatgccggcgccggcgacttatgaggagcagccggcagctgtcagcggcgtcaaggcggccgtgcaggccgcggcgccggtgctggtggtggcggagagcagcccgccagtagctgccccagcagtggcagtgccagcggctgtgccggcacacccggcggctgaggcggagggcgagggcgtagttgaggcggtcgtgactgggcagcaggcggcggggcaggagcggcatgaggcgccactgctgatgccgttcggcggcacgctgcacttccttagccccatccgcctgacgctcacgctgccgcccacctaccccgccgtccacccacccgagctggacgtgcaggtgtgtgtgtgtgtgtgtgtgtgtgtgtgtgtgtgtgtgtgtgtgtgtgtgtttgtgtgtttgtgttgcgtgtgtgtatgtgtgtgtgtgtgtgtgtgtgtgtgtttaaagtacgaacagaacgcgggaaacggtcaacacttgcatgtatgtgtgtgcgcgtgcgtgcgtgtcagcaatcacagggaaagaagaccgtgtgtatgtgcgtgtgtgcagcatagcgtgcggcggacggcaagatgcgtggtccagcattgccttgacacgcgcttccccatgcggcacctgcccgcccgcaggcgctctggctgtcggaggcgcaggccgcgcagctgcgggcggcgctgcgggcgcagtgggcggcggcgggccccggcacgcccatctcctttactctggtggactggctgcgaggcgaggcgctggcggagctgggactcactggcggcagcggtggcggtggcggtggcggtggcagtggagggaagctggtgctgaggcgcgggcagcagcagcagcagcagcagcagccggcggtgactggggcggcgggggcagcagcaggcggtgccaagggtggtggtggcggtggtggtcagagcctggaggcgctggcgatggcgctcgtgcgctactcagcgcggcgggagcagcacgtgttcgacgagtcactggtcaggtgggtgcaggagctgaaggaagtcatggcaccaaacaccaccagtgctgggctactgcgcgtgagtgcggacgccatggtcctcgctgcttcgcccctcccatcgtccctagctcgcaaccaggtgccctctccgctcccgcccctccctcgcctcccgcctccactgacctcccctcccctccccccccccctcgccccccctcgcagctgccccatctgcctggaccagcagctgggctcccgctgcgtgcggctgcccgagtgccgccacgccttctgcgttgcctgcgtggccacacacctgcgcacgcagctgggcgccggcgcggtggacaacatgcgctgccccgaccccgcctgccgccgccagctgccgcacggcgcgctgcagcagctgctgagtgccgccgagtacgaccggtgggaggcgctgacgctgcagcgcaccctggacaagatggaggacctggtgtactgcccgcggtgcaggtgtgagggcgtcgtgtgtaagggcgtgtgtgagggcgtgtgtatgggcgtgtgtgagggcgtgtgtatgggcgtgtgtgaaggcgtgtgtgagggcgtgtgtgagggcgggtggctggtaggacatgagttgcgctgcatgtttgagatgagccacagggtgccgcaggatctggtcgctgggtgccacggagatgtatgtgtgtgtgtgtgtgtgtgtgtgtgtgtgtgtgtgtgtgcgtgtgtttgttgcccctgtcacgctcatctgccgctgccgctccctgcctccccaccgcgccgccccgccccagggagccgtgtcttgaggacagggatcactgcacgctgtgcccctcctgcttctactccttctgctccctgtgtgaggaggcgtggcaccccggcaggtgcgagcgccaacggggtatgcggcatccacatagggggttagccggggagccaagtgtataatttagaatctttgagggggggcggcggtgggagggcgcgtgcgtgattgcgtgatgcggggtacacatgccatacgctaaagccgcaacgcggccgcaccgccacgccgcaccacgcagcagtatcaccttgcgcacgccattatgggtcgatcgggcttgacaggggctggcaggggttgacaggcctgacaggggctgacatcttccccttatcgttgggctcgggcctgtaacaaccctcccctcccccgccccacacttcttaaatagtcatgaatgtaaccccccaccccccacacacagccggtgcctggacgcggatgccaagctggcgctgctggaggcgcggcgggcgggccgcggcgaggcggcggcgcgtgagagcgccacggagcgggctcggcgcgaggtgaacaagatgaacgagctcaagagcctggcgctggtgcaggtgggtggggtgacgaggccgggggggggcgtagccatgcatatgaacggtttgttttggggggtcagcagtagttacgcaccgcctggggcgttcttgcatacctgacaaagggcgtgtacgtgcgtgtgcgcgcttgtgggaaggctggacgcgcggcttgggggcgtggctggctgtagttaccgtacaatgcccctcaccgctgccgtttgctgagctgcctcctcaccgccaacttctccttctgcttcctccccctcctcctgtttcctcccctcccgctgctgccgctgccccccccccccagagctccaccaagcaatgcccctgctgctccatggctgtggagaagaccgagggctgcaacaagatgacgtgcgcctactgcggcgtgtactggtgctggaggtgctgcagggtgagtgcgggggaggtgggcgggaggtgggccggagcggggccgcaacggtgcgcacgctgcacggtaggccgctgccacatgtcttacgactggagtatgtttacgtgtgcgtgtaccggtgacaacgtagcgctgttgccgctgccaacgctcctgctgctgtcgttcccaacgccttgctgctgctacgctgcgcctgccgcagatgatcaagggctatgaccacttcaaggaggtgggtgtggcggcatgtgtgccctactgatgccgggccgtgtggaggggagtggcgtgtagaggcgcaggagccgggcgggggggcggacataggtgcatgtgattgagcaggtcagccatgcacaggccccaggccccagcacatctggatgcgcatgcacaatttcagtggcttgcgggatgtcgcacctcccacaggacggctgcgagctgtttgaccaggtggagatcgaccgctggaacgcgcgctggaacggcggattgtttgagggtgagcaggggtaggggctgcgggcctgagggcctggtgccgccgtggtttgggggttgtttgttttggagcggtcaaatgacctatgtatctgcaattatgcggtcgtgtgcgccccgctcctgcagctccccggcgaaacgaggtggaggataacttggcggcgttgcaggttgcccggcgcgtcggccaggtgcggtcggggggattgtagataccagcccaactaaaccgaacccaatgcctagtcacctcctgtcccgcctgatgtcgtctttatttgttgtgtctgcaatcctgtcacgcatccgtcgcaggggcgctggtgccactgcgttgtgtgcggacagcaggtggggcggcagcgcgggcagtggggttgtggacagttgtgggcgttccttcggactagcagtgcaaatgtgtaccccatcgctgacccattccgcttagggggcaccaacgccagggcttagcgtatgggttgagcgcacctagcatgttaccataccatccgcactctttgtgctgcttgccgccaccccgccccctgcagaaccttaaggagggccgcaacaacaacatccgctgctggtcctgcaacagccacttctgctacctgtgccgcacgtggctgcgcaaccggcccggcgcacacttcggcacgggcgccggccgctgcaagcagcacaccgacgactga

SEQ ID NO: 45 - DNA, 3889 bp, Chlamydomonas reinhardtii
atgcatttggcaggtgattcttgggttgggccctgtggagaagcttttcgcggaaaatgacgcagtgccgatctcaagatacgcaacgcggacagttgttttactttatatgctttgctggccatcgcaggctctcgcagcgtgctcgctgggcagcgcgttggtcgtcgcacctctcattgcccaactgcctccaccagcgctgcagtcgtcgcgcaggcctgccctcacgtaacgaccacagccataacctcgcgcacctctagcgccatctacgctcatcgcgccacaacctcgagttcgctgggcacccgccaccgccatgccgccaccgtgcgacatggcaccggcgtcggcatttcggcagccccccgctccgccgcctcctccgcctccggccgcctgctgctgctgcgcggcgcgggcgcagcttcggcagttgcgcaccgcggccgcggccgcagtggagtggctgtagccgtgtccgccaatctgtttgcccgggttgcgcgcatcgtgaccagcttcttcaacggcctagtcgggagctttgaggatcccgaggtaagcgggggagggcggagggaagaacgaaacagataaaagtatggaaaatgaaatgccagaagaggcggcggtatgaggtatgtggtatggcttagcagaggccaatggtaagctgggttgaggacggcggcgactgcacaggtagctgcagtattgtgtatcgccctgccattcatgtgactcatcaagtatcgcctctcattcttcgcgtcacgtgtacacgctcgaacacaaacggttttgcccccatgcagaagctgctggaccgagtggcggaggagatgcaggaagacatgatgcgaatgcgccaggtgtgtgtgtgtgtgggggggggggggagggggaggttatttggcggcgtagagggaggcgggacgagctgtcacaggccgtgtcgcggttttccccacggtgcccgaatcaccggctcttccgtgtatctcatacttccccacgcacatcctccgtcttccctgtccacctccttcctccccctccgcctccccctccatccgcctccccacaggccacggcccaggtgatggctagccagaagcagctgagcgccaaacagcgcagcatgcaggtgcggaggtggcgttggtggggagagggtgggaaaacggaaaaggagtatgcaggtgccgtggcgtggcgtggtaggagagggggcagcggagcatgcagataccgtgatgtgggatggtggggagctggcggctgcgcgcgactgcacacgcaagcggctgtggtgaacgcacgggtggcgggttgtgctgcggggtctgtgggggattgctctgctttgtgcgttgtgagcaagctccgaaccgccttgctgctggtccaacttgcaccgttgtttccaaccccctccccaaccccctccctccaaatcccctccctccaaaccaccctccacccacccccacctccccgcacagtccagcgccgaccagtggctgcagcgtgcggagctggccgtggctcgcggtcaggacgacctggcgcgggaggcgctgaggcggcgcaaggtgctgcaggaggacgcgggtgagggaggcagcagcggtggggggtggggtggggtggggttagggatggggtggggtggggttgtagataccagcccaaactaaaccagacccaatgcagtagagcgaggaggagagcgtggcctatgcttgacaatggagtggggtggggggcttagggaggtgggggggggattagggaggtggcggggggggggagaagggagggccaatgtagtaggggttggggtgaagggggaaaggccgagagggacaggggaggggaagaggagggaaacggggagggaaaggggaggggacgggggagggaaaggggagaaggggcatggacgggggagggaagggagaggcacgaggaaagaaaatcagtcgcggactcgaatcaaatgagcctcagtctttcggtttcggcccgccttccgtcattcggtgcccattcggcgtgcagaccgcatgagcgagcaggtgaccctgcagacacaagcgctggagcagctgcaggtgagaacgagggtagtgtgtttatgtacgtgtgtgtgcggggggccgggttgagggtggctggaggcccgaggcgaggcggcggctcgtcgggcgggggctggcgtgcgtgcgtgcggtcgggcaccgtgcgtgtgcgtgtgtgtgcgtccctgactcgtcatcctctctgacttgagctcttactttaatctcgctgcgggggccgtcctcacgtcctccgccgacgccccaaagcccgtttccctcccccacgccccactccccacgccccacccccgcgcccccccctaacgccccaccccccacgccccataccacactccccccgcctccccccccacccccaggccaacatccggctgctggagggcaagctgggcgaggcgcgctccaagaaggacacgctcaaggcgcgagccgccagtgccaagacgtcgctggcgctgcaggagatgatcggcgggctgcaggtccggtccggtgagtggattgcgtgtgtgcgtgtgtaagtgtgtatgtgtgcgtgtgtgtgtgtgtgtgtgtgtgtgtgtgtgtgtgtgtgttaaaaagacgaagcccgcccgtgtgagtgtgtgtgtgccctgtgcgtctccattgaccaacgtttgtagctcccgccgtgcgtgccctatgagggtcagcatccaacacagccagttgtgtgacactgactatttccatacccgcacaccggtaacctctttcgcacctgcaacctctctataccttttgcaggcagcagctgggccgcgtttgataagatggaggagaaggtgcgcgcttctataccgtaccactggggcggcctcgcccgtcgtgccttacttcaatctccgtcttgaccctcgtcagttagcacaggatgatgaaatgccgctgacgtgcacgcttgcttgggcgggcttcgttctgttgcgcttctaacatacgcaaacacacacgcacgcacacactgggttctgggaatcagctgcaccctacgggactttaccaacgtgccttaccactgtcccatcgcacacacacgcacacacaggtggctgcgctggaggctcaggcgcagtccgccgccgcgctggccgcgccggactccctggagcggcagtttgcggcgctggagggcgacggcggcgtggacgccgagttggcggcgctcaagcaggtgcgtgggtgcgggtaggcgggtaggcgggtgcagggggttggatggcagggggttggttagatgggtggaatgtgggtcaggtgggtgggatgtgggttagatgggtgggtaagcgggaggagcgggagtagtgcaagtgggttaggcgggcgagagcagtggaaggaagagtagcagtgggagcagtgggaagagaggaagcagtgggaggagaggaagcagtacgtcacgtgcgtggatgggtgcgggggcgaccgccaatggggtggaaagcgaagtttaggtggtagccgactcttgcacggaatgctgtctgctacctccgtctcccccccagtctgcataacaacaaacatttgcaacttcttacttcctttctcctctcatcaactcgtgcggatgcatggacatgcaggcacgccgcagctaccccgcccccgcacttccccgggactccacggccgcgccctccgctgccccctcgtcggccccgcacgtggcgggtcggccactgcgtgacgtgtttgacccgctggagagggagctggaggagctccggcgccgggcgcgggagtga

SEQ ID NO: 46 - DNA, 2341 bp, Chlamydomonas reinhardtii
atgacggattcactcgccgcggacgcagcgaacgttgtgcgccggttcctggagacaggcgcgcccacgtatcccggtcccacgcccagcccatcgccgagcccgagcccgagccccacgccgacgcccagccccagcccatcgccgccgctggtgcaggtcgtggagaccgttctgaacgtgtcgtatgacctcaagtcggtgtcagcggagattgtcctcaacagcacagaggcggttgttggcaccgtagtggacatcgttgccctggtgggtttggctggcaaacgcggtcgggcacacacgtaggcattggcgtgcgtgtcgttgggtgggcagggtttgtgttttccgtctgcggcacgctcgaacatatgagttaaaaggacttcaacatatgcatgtggattttgggcactcgtgtgggcgtcggttacaagcttctcagtcgcgaacgtcgacatgtatccaaccaactttcgttcctgccttccacttcgcaggtgcgcgaaagcattgcgaagactctcggcattaacttcacgcaagtcgtcattaaatcaggcaagttctgcgctacattcgctggcctcgtcggctcctcgcgcgcgccttccttgcggcctttgggcacccgacctttgggcacccgacctgccccgacctttcggagccactcacttgaacgggtccaacaatcagtccaagtgcacttgcccctgcagcacacagtctgacaagtcttcagtcccacacgactaaaccccttacgtgctgcccttgcctccccgcacccccaacaacagtgtccgcgcgcattaacggcgtggaccaagtcatcgcgggggactggaacactctgcggcggcacctactccgccgcatggccctggaagagctccccgcccccgcccgcagcctggcagactccctgcccgccctgcacggcgcgcccggcgaggtctcacactgcggcaagccccgccccatcagccttgccgaggccgagcgaatgctggcgcagggctcggccctgacgtactcgtacgacgcgcgccgcatgcttcaaggatccggatctggaaactccttctctctagacgccatcaacattgacctgagcgtcgtgcagtacgtggaggtgccggtcgagccgtccatcccgccgcccaccaccaacggcaccaccaacggcaccaccaacggcacctcgccctcgccgctgccgcgtccctcgctcatccccatcaacaccacggcgctcacgcagattctcaacgccaccaccatcaatgccaccgttatccaagcgccctcgcccacacccacacccacacccacgccgccgccgcgcgtgcttttcgctcgcttcaagggtgccatggccgacggagtctacaccaagggcctggaggtaagcggcttgcttttgtctgccttttagtgctaatgcttggcgtgtgcctaggcattcaacgttggacccgcaactactgagtcttaccttgccttccgcccctgctgcccatcacagcccgccaacgcctcgggcgtggcccccttcgtcatctggcgcgaggacgcggactttgacaactggcgccgccctcgcaaccgagccaacctggtccacgataagcacctgagctgcggcgccaacaccgtgggcacctgcaccacctgccctcgcgcctggcaggtcggcgccgacagcaccaacgccaccatcctcttccgcgagccgatgcaggtgagagcaggtgcccgtgggcttttgtgtgtcgcgcttccttgcgcccatatgctgctgccattaccatgctgccaacatccggctggccttcctcctccgaccaagcccctcgtttccacctcttgcaccgccctgctaagctgcaacctcccgccggccccctgcttcgccccgcccacacagcttgaccgcattatcatcaagcagctccagaatcctggcgtgctgaccgtccagctgctgccctggcccgcggtgcgcatccccggcctcaacgccaccgcgcgcaccggcaccctcggccggcccatctggtccgtgacctccgacagcaccccgtgcggcggcagcctcaccatcccgctcggctcgcgcgccggcaccggcctggccgtgcccaagcgcggcagccagtcgcttatcccccgcaagctgcgcagcaccaccgtgggcggcatcagcatcattgtcaaggcccagcccaaggactgctccaaggcccccggctgtaccttcattgagtcggtgctgtttgacgggcgcgtgctgtacccggccgaccccgccgccgaccccagcactgtgtaa

SEQ ID NO: 47 - DNA, 3498 bp, Chlamydomonas reinhardtii
atgcttgcccacacgaaccttaccagctcgggcgcgagcacggtgcgcccagctcataagcgcttccatggtcgcgtctccgtcgttccacgcgctgctgcgggtgcccccgcgggtaagtggcatacccctattataaccagtgccagtaagcggccaaggggcaggcgtgaccccaggccggccgtgcccgagcgggtaccgtgtggcacacggcgtttgaggccccctgaccactgacacgcatcgttgtttacaccctattcctgcagccatctcggcggccacggatgcgctagcgaccctccggagcgcggcagccaagcccggctctgttaagccctcggacgtgctggcagcaatggtaacggtggagaaggcgaagctcaaggtaaggtgccatacgagtggtggtgcagtgccgggggcccgtggcgcagtacgcagtagcacattcaacgcgccttgcctgatcccttccggtgccggcactgagtcccttcaagtgccccgctttcgatgtcgcctgccattgacccatgcacccaatcaacctccgctgctcccccgccgctggcccacacacggccatacagccggagaactgggaggccaacctcacggcgccaggcacccgctggcggctcgtctacactgtgtgtgagtgtacggtggcccgcgcggcagcgcttatgggtgtgcgtgtgcgggcgcggtcatgtgtgtttgtgcgtgtgcgcgtgcgggcgagtgtccgttgcggaacggtgacgaaccgaaagtgggctgccaaagcatctagctggccacctagctcgctagctagttagctatttatcatggtggcgctcaaggtatggccatcacatgttatctcgacgcctgcacatgagctgactgacgtgcgtggaagccccaacgctgtcgccgtccctcctctgcacgcagccggtaaggacctgaccgctgcagccaagaagcagaaggccgggtcgggagcctacttccccatctccgcatgccaggtgcgcgggcggcagacgccaggcctgcggcaattgcacacgtgacgggcatgcatggttcgacagcatccgtagttctgttcgggtcccgcggctgctacgctagacagcgccgcgattcgccacgagtcgctgcgattcaggttattctgaatgtacggtgcatacgtatgtgtatcctgacttggatgtgtgtggattaatgctgtccctcgtgcagaaattcgacgacacgggttttgagaacggcgtgttcttcgggccggtggccaacctcaccttcaaggggccctggcagctggacgcggtgagcggggttggggtgggaagggggggttgtagtttccagcccaacctaattcaaaccaagctaaaacggggagggggtatccgtttatgtggaggagaacggagtgttttatgcacaagtaggggggccgcggggggctacatgcccgagcccaacgagcaagtcccaggggcaagaggggcagaggggcttgcgcatgaagctcgcacacacagtgtcgcctgcgcgacgcgcctacccacttgcttggagcagcatgtgaagaacaccggaatattgcctgttccggtgacaatatcagggagcccgaccagtctccggtcggtgatgttgcaggctgggcatgtggtcatgagcatcgccagcctgtgcaggcctgctcgcccgcgctgccgccccatggacaccgcgatggacttggacagcttctccaccttgtccttgctggcctgctggcccagcaccgcactcgcaaggggtatgtacttggccgatggcgccgagcgcagcgccgacaggtgcagctcccgggacttggcctccacctcctgagtgctggcgtccggccccagcaactcacgcgcctcggccatgtaggccggcactgcgcaggatcccgccgccgacaggtgcagctcccgggacttcgcctccacctcctgagtgctggcgtccggccccagcaagtcacacgccttggccatgtaggccggcactgcgctggatcccgccttctggccccgccgccgtgctgttggacctggacctggacgtgagctgcctccgtggcagtggctgcgagaaacagcatcagcactgccggccgctgctgtacaaggaggcagtccgggccttcacagcgtgcatgtcgtctatacgagaagacctggaccttgacctggaggctgcactgaagctaatggacaaggtaacagcacggcggcggggccagaaggcgggatccagcgcagtgccggcctacatggccgaggcgcgtgagttgctggggccggacgccagcactcaggaggtggaggccaagtcccgggagctgcacctgtcggcgctgcgctcggcgccatcggccaagtacataccccttgcgagtgcggtgctgggccagcaggccagcaaggacaaggtggagaagctgtccaagtccatcgcggtgtccatggggcggcagcgcgggcgagcaggcctgcacaggctggcgatgctcatgaccacatgcccagcctgcaacatcaccgaccggagactggtcgggctccctgatattgtcaccggaacaggcaatattccggtgttcttcacatgctgctccaagcaagtgggtaggcgcgtcgcgcaggcgacactggagaagttgtcggatgtgcaggtggagtagtaggtgacatttatcaatgggtgatgctgctggaggatggcgccggcacctgcaactatcagaacaggcagtatgatgcgtgctgggtgatgcatgctgggtgatgcgtgctgggtgatgctactggaggatggcgccggcacctgcaactatcataacagtctcccctgcgcacacacattcccgcgcgtatcccatttccccgcccccacgcccatcactctgtgcaacgccgtgcctgcgcttccacgtcactttcttctaattcgtcgtgcgtggaaacccgacccacccccatcccgcccgcagaaagtgtgtcacttcgacgtcaacaccatgtacctgggcctgggcccctggcgcctgcccatcaagctcaaagatcagacgccgctcaagcagatggccaccaagtgagcccacagccgcacacaggacctgagaacctaccaccacaccaccgtcaccaccacgccaccatcacgccgcgccgcaccaacctaccaacacactcacggcatcatgctgtcgcctaaccagacctttaactacaccttgccacatccaaccacaccctgtaaacacgccttttaccacatgcacgcctttcctcctgcctcagggagtttaaggcgctgccgttcttcgtgtacgcctacgtgggggaggacattgtggtagcgaggggtcgcagcggcggcgtggcgctgtggggccgagccgacgccgcctggctggccacctcgggagccatgcaggtgtacaagtag

SEQ ID NO: 48 - DNA, 28072 bp, Chlamydomonas reinhardtii
atgtttgagtcccaggttgcgtactacctggatcgataccttggccagtacctgaatggtctggatgcagcggcactccgaatttcggtctggcgtggcgatgtcgagctcagcaacctttcgctgaagccggaagcgctcgcggaccttgacttgccagtgacagtcaaggcgggcttactcggaaagctcacgctcaaggtaacgcgtcggagctgttcgagttggagctgttccgagttgggtggcggggctgggtcagcaggcggtgcccttcttgaccaagctgtcagaccggggttcggcccggcaaggatggagattacgagggacaaacagctgttggcgtgctgttgcagttaaaatgataccgaccagcccgcaggcgggggaggagtcggagctagccagagccgaccaaggcagcaaaaccctaggcagcaaacgggcagacccgcttcacctcgcgagtacctgtaccggtggccccgacgcggactccgcaatcactgtagcgtataactgctacctgggtgcatgaagtaactgggtgcatgaagtaactggtacctgggtgcatgaagtaactgggtctcgcgtgtgtcacaggtgccatggaaggcgttgggtcgggagccggtcgtcgtggagtttgaccgcctctacatcctagccggacccaaggagcagcagagcgcgcagccatgcaaggtgggttgaggatagacatgttacaaatgatgcttatgtgctgccatgagggctgacggagtcgcgcatgagtaaggctttcatgccgcgaagcctcttgcatgtagctcagccggcccgggcccagtggaatggctgggagtcagtaagacggcgacaaacacatgtggggtgagaggcatgctcgcaaaatgcatttgcatcccgcaaacagatgtccgtgtcagagtacgaggcggagactgtggctgcggagttggaggccaaacggcgccgcgtgctggcggcggagacggcatggctgcaggtactgcgtgtgtttgggtcgaccgcgcgtgcgtagatgtggagtttggcaacagaatggctcgtgactgggcgccagctgggtggcaggggcacatgcatactgggaacgggagcgatgccggcccgccccgcgtgggctctgtggactgtccctacccaggagctgcaggccaagctggcgctcaaggcggcgcagctcaagggccagctgcagaagcaggcggcggcggccaagtccgagggcggcggggggctgttcaacctgcaggcgctgatgcacacggtgctgggcaacctgcagctgcgcctcaccaatgtgcatatccggtgcgtggcagcccacgggttacagacagaggcatttcagggtcatgtgtcaatgggcggcgatagtgtggatgcgcatacgcatggtcttgtgctgtgttatctttccatccacgtgtccgcatcagaactgagcctctgcattggagccacgaaagttggatatgcttgctgcgtgcccacatcacacgaacccacgcccttttcgcgcacagttacgaggacgggctgtcgctgccgggccagctgctggcggcgggcgtcaccctggagcgtgtgtcggcacacacggtagacgaggccggccgggagaccttcgtcacgtcgggggtgcttcagctgctgcgcaaggtgggcgtgttacgtgcgtgatggggcacggagttctccggggtttgggactttagatcactctcctcatgaccccagaattctttcccttgacacagacatgccggtatcaatgtttttcgccccctacgcttgttctccctcccgcctaccctccctccctgcctgcctcctaaccctcaggcggtggtgcttcaggagctgggggtgtacttcgacgtgggccgccccttcttggtggcgccccgcgccgactggtcctcactggtcatctacgagtgggacgcgctgttcctgcccgcacgccacgcccccggcagctctgtgcacccgcaccacttcctggtgatgcccatcacgggactcatgaactacgtgcgcaggagcagcaagacgctggcggcctccgccagtgccgcgggcgccaccagtgccgcggggccactgcccaagcaggagggccgcattgcgctgcgctccgtgagcctggcgctcagccggcagcagtacgtgggtagccgggcgctgctggagacactggaccgctacacggccaacagcccatacagggccatcaggccaaagggccggccggcggagggtgagcgggggcgatgtggcgctttgtgggggcttctggtgttccaggtgtgcgtgtgtgtatgcgtgccgttgtgtttggggccaggtccagccccaagcatccagccaacgctgttcctccgggggcaatgctgcccgctggtgccgtgcccacatatgttcccgcgtcaacaccacacacggacctcgcaggcgaggctgcacgtgtgtggtggcgctacgccttcttgggggtgcgcacgcagctgcggggcagccgggtggcctggacgcagctgcgcaccgcctgcctgctgcgcaaggcctacgtgcccgcatacgtgcgctgcctcgaggcggcgtcagcggcggcggccaagggcagtggtggcaagggccagggcgccgggcagccgggtgcgcccactgcgggtctgggcggtgacgcggccattgcggctatggacgcgcagctgccggagagcaccatcctgctgttcaggtaggcaggtgcatgcggacctacggtagggaggcgaagcgtgtgtaaattgcaacctcatttgcaacggcgcgtgcaggcgtatggcccacgctcagctgcagctgaagcaggagaggggcggcaccggactgccctctcgcggcgccagcaccacctcgtcgtccgcctcactgctgcagcagcagccggggcagcaggccgctgcagcgccagctggcgcacctgccgcagcgcccgcacaggatcgcacctggatcggctggtggcgcggcaccaacaaggctgccgcagcggcggcagcagcacctgcctcgcccggcggtgcgcccgcttcgggctcggtgtcgggcgggtcggaggtggtgatgggccccagcaccgcgaccctcagcccggaggagtggggccgcctgcaggagctgctgcagcagcaggtaggcgcgctgggagagtagggctggagtgaagacgttacatgtatacgttgtgagttatggaatcgagattcttgcttggacgctgtgaggatgtgcagcaatgcacttagaaataggtggaagggaagggttggacaccgtgcatgctagagatgccatgtgtgtgcctgggtactgacatttgcctgcgcacttcctccaccggtttgcgcctgggcaggagtttgcagacgacgacgacgacgacgcgggcggtggtcgcgacgggccctacaccctgcgcacactgctggaggtggctgtggagcgggcctccttggagctgaggggcgaggtggggcaggtgggcgcagtgcccggcaccgaccggccgcggcccatcctgctggcctccatgcggggcctgggtgtgcgggtgctcaactaccccaccgccctggcgctcaacgtgcggctgggctgggcgggcgtggaggcgccgcagggcatgctgctgtgcactggccagctgggcgcggcggaggggctgggcatggggctaggcggaagggtggcggctggaggcggcggcgagggaggcgctgtgttcggcggtgtgggcggcgggctaggtcggtccgggccgcccacccgcaccgccacacccgctctgcgatccagcactccgggtgggtcgttgaagccagtggcctccagcgccgcactgcccgccacagcaccagccgaggcggacgggcgggctgcagcccagccgtctgagccgctgccgtgtgccttcatgctggacttcatgaggcggccgcaggtgggcgcgggaggatgggcagattgggaggcggggccggcgatgttggattggaggctaatggctgcacactcgtgttgttcaccggcacaacttgcttcatcgtgtgctgaatgtaattgtattttaccccggtgatgtgacacggcccccgccctcgcccgcctgccaggacggctctgctgacgcggtggtgagtgtgcggctggcgcccagctacgtcacctacaacggcgcggcgctgcgggcggtgggcgccttcttcagcagcagccagcaactgggcatcggcacgctgcaggtggggcacacgcggtggtgcgccggatgcgtgcaaacgcttaccgcttcaacagccgtgtcggctcgcccgcattgctactgtgctgtgtggtgcgccgcctttggagcgcatctgcacgctgtgcgctgaacccgtgaatgaatgaggcttttatggtgaggctgcgttcggtctccccccttttattggggggagaccgaacgcagcctaaaggggggagaccgaacgcagcctcaccatccgtccgagcccgtgtcgtcctcgtgctttgctcgctcagattcaatcactcctctttttaggttttccatttgactttgacgttgacttgtccagcgtgtgaccaaggcctcgcgtccacccatccccactacaggcccaggccgccgcccgcgccgcccagctgcagcggctggcggccctgcggcttaaggcgctgtcggccgagcggccgcggctggcggtggcggtggtgatgcacgcgcccaaggtggcgctgccggacagcaaggtgcggcggctgggcggcggctggagtcacggacccgggtttgcagtctgagtccgggagcctgcaataggtttacggggactgcaggcagggcggcgggttgtgtgtccaggttgtcttgtacctatgcattgcctctgctgcatcgctggccgtccagggtcgcgccacgctgctgctggacctgggctgcttcagcctcagctccgccacacccgacagccagggcctagctgcggacggcgaggaggcgggtctgtacgagtgcttcacgctagggcttgagcggctggaggcgggcctggtggggggagcctttgcatggccctccacacagccgccgcaggatgaagacggagacgatggcgccagtggcgacggcggtttggctagtggtatgacggctgcggccatgacacggtggggccccgccgctcgggcggtgcagacgggcggggctgcctcggacgcgctgttcggacccataccgcagaagccttcggcggcagcggcggcggcggcagcagcagcacagactgcaagccgcgagcagccgcagggtctggctatggttgcgggcatgactgccaatgaggaacaagaggcagcggcagacgattcagcggccggggccggccgcacggagtccccacagccccgcaaaacggccagtcgggcgagcagtgcgtgtggcagtagccatggaggagggacggaggaggagggcgaggagggcggtgctgcggtgcccggtgtagccgacatgggccatcacggtggtctggcggacctgttgcgtcagctggcgctgcaccgggcggcggcggcggcactgcagggcaagggttccgccgccgccggcgcctctgacgagcctccacctgagctggtgccgctgctgtcccgcttcggcgtgattgcggcgctgcaggtggccactgcgccgcacccccggctgccggctgtccgcacccggctggaggcctcgccgctggtgttccgcttcagcccctggcgcttccaccgcctcatggccgtcatcaacagcctggtggcctcactcagtagcggcagcagtggcggggggacaggcggaggcgcagccgacggagcggccggctgcaaagaggcccttcaggtgcggctgccgctgtgggtgacggacgccgagtacaccgcccccgtacagctgctggtgtgggagggggtgggcggtcgggtggccaagtggcagccccggcagctggtggtgtggcgcggccgcgtgtacctcagccgcagccccggcagcggcgtggtgtctgagagccgcagctactggcgcggctggcggctggtggagctgccgcccgaggaggtgggcggggccgagtgtgcggtggcgatggtgccggagggcgtgcggcgcgaggcggcggcggaggcgcctgagggcctggtgctgcggctgtctgaggcgcggcaagtggctgagctgcgccgcaatatgatgcggtcggcggccctggtggaggcggtggcgggtgagtgggcgggagcagagacggcgggtgggtgcaaggcagcgagttgcgcgggtcacaatccgggcctgagaggcgcatgcaccccagcgtgcacagcggcatgtcttcattggtttgcccgctgtcgtcttcaattctgaactgggctttcacgccactgacaattgacaggatacatggccacggacgcgcacattgagtcgcctgactcacccaacgccacgaccggcacagcagcaggcagtggtgtgggcggcagcggctccgtgggcgtgactcgcgacctgctggatgagctgctggcgcacagggacgtgttccagctgtccggacgactgcccgcactcacactcaaggtgtcaggcaggccgcccagggcatggagggctgttcggcggctggcggctgcggagccgctgtcagcgggtggcacggcagcggctgctggcggcacgtacggcgatggcccggggccagctgcggaggtgctgggaaacatgtatgcacagcagcagggtcccgagtcacacgctggcacggacgtggagggcagcgtcgccggggcccgcggcccggtcggcaccaccaccggcactggcggcggctccacctcatcgctcagtgaggcgggggtgccctccgcgcctgcgtctgtgctgtcagcctcggccaggaccacccgatccagtcgcctggcgggtgggggccagctgccgccgcgtccgccgccgtcagtggcctgggggccggagggacctggcgactcggcggctggggggctggcggagccggacgcggacccgggggagggcggcggcgaggagggcgatgatgctttcgaggacgcggatgactacatggatgaggaggacagctcggaggcagatgaggatgaggaggacgaacgattcagcagcgacgccgccagcggacagcggagcccgggccggcggggccacagcactgccgtcgccgctctggaggccctgcggcacctgtctctggaccaggagacgccgctgctgagtgtggctctgactgaggctgacgtggcgctgcagtacagcgccgaccgactggcggtggggctcaccatgcaggtcaggcagctggaacgtgcgggtggaggggggtttggcggtggggctacacagcgggagaggaggggtggatggggttggcagcagcagcacacatgagcgtggagaactggcatgatagtgcagctcaccagtacaagcttaagcctgacgaggaaggcgcgcatgtctgtttctgccctgcatgtccccgcccccaggcactgcgcatggaggatgagctcatgggcgccgcactgggccgccagttcgcagtcatggcgctgtcctcctcaggcccgaccgcgccgccagcatcagctggggccaccgcccctggcgctgaccccgccggtgctgacatccccagtgagtcagcgcacccatccgccattaactggcagccggtgcccatcaccaccgcgggccaggatgccagtgccggtgccgccagtggcagcgctgggcctgccgctgtggcgccgctggcgcagttcagcttcatcagcaactcctccagctccgaccgctacaaggtgcggcgcatcgctgagtttgcgccagggtatgactgcgggcgatacgggacctgcctggaacagccactcgcattgccctctcgcattgttcccacgacccgcgcccaccccacagggtctggactcggagctgggtctgcagctggcgggtctgacgctcatgtgccaccgccccaccatcgccgctctcatggggctgggctcggacatggggtacgccaccgcgctgctgtccgccgagagcggcacgcagcagcaggccggtgccgcgcagcttgccacatctcctgcccctcctgctacggctgctggtgctgctgctggcatcaccgccccggcacagggcgcaggtgcaggtgcaggtgcaggcaacgacggccctgttcgtgcgggcggcgatgggcgcacgctgctgcggctgcacatcagcatgtcccgcctgcagctggtgatgccgtacgaggtgctcagcgcccaccagcgggtggagccggggctgacgcaccagcaggtggtgctgacgccgcggcagttcgcacaggcggccatggacaattttaggtgggcccggaatgagttgttacaaaagcacttacaagcatgacggcttgctcctgttgtgaaatcggtttaccgtagtgcggatccgcgcacaccacacgaacggctccaacctgtccgttgagcgaaaccctttccactttcccacacccgccccatccaccccgcacctgtctccagcttgcgactggacgtgcggccgacctcgctggagctgtccaccagcctgggcaacttcacagcgcagtacggcgcactggcggaggagtcaccgtacaggaccatatgcagcctgcggccgggcagcagcgcgggctcgctgattgaggtggtgttcaggtgcggggcaggcgcgacacagctgggataaacatgtggcacaacttgcagatttggaattgcttgatgtcgcttctcagctggcatccactctgactcaccggtgccatgtgggccctcacaggatgcactctgccgcggaggccgccgctgagccgcgtgtgccggccggcgccgcctactcgtccctggtggcccggctgagtgcggtgcaggtggtgtacatggggcgcttcctgaccgagctgctggcttacataaatggtaaggggggccagacggcggtcgactgcagtcggcatgccgcagacattgcgtcaggaaagcatggctcgtctcgctttgcaagttgcctcaacactgcttctggctgtttcctcctgcaggtctgctgtccatgcagccgcgggcaaggccgcccctcagccccgccacaccaccggccccagccgccactccggccacacctgcccccgcggcgccggcgcctgcacctggcgcccctgcccctgccgccagccccttcgtgctgctgatggacgtgcaggcggcggcgcccgtcatcaccctgccccagagcagctccgcggcgcaatacctcaccgcggacctggggcacctggtcctgcgcaacacagtgggctggaggcactgcggcggcgcggtggcgatggcgggagctggcgccgcgccaggcgtctccgtgcccgctgtgtcggatgccactggcgccggtgtgcggccgctacccatggtgtcaggtggcggcgctccaccctccgctggggacgccgtcggcagcagcgacagtggcggcagtggtggcggctggcgtgtgctgatggacgagatggtggtgcggctgcgggacatgagcctggtggtgggggcgggtggtggggtgccgcccggtcagaacatcattcgtgacgtgggtccgtccggccttgggctcactctgtaccggccactggcaatcagtggcggcggcagtgacggtggcagtggggctggcagctcggaccagccagctggcagccgccagccgcccatgccgccactgcatgcggcggtgagcatcccccggctgggcgccgtcatcagcgagctcgagtaccgccggctgctggcggtgctgtcaggcaacttcgctgagccgccagtcaacgacccccgagtgctggagctgcagcagctgctggccaggattgctgcggctgccgccgcggcgccacccagttcactagccccgcccgccagcagcagctcgccggctccccaacccagtggtgcggcacaggcgcagcagcagccgcatccacccaaggcggcggcggtcggcaaggcgggcgctggcggctcaggctcagctgacggcgcctccgccgcggctacccagcactccaacagtctaccccccagccggcggcctgtgttcctggacttcaaccgctccatccgctccgtgctggaggcgctgcaggacacctgcacagtggaggtgagggcggatatgccgggagcctggacaggccggggtgccgtgcctgtggtctagtgcctggtgtggtctggtgcctggtgtggtctggtgcctggtgtctggtgcgttgaccacagtgttgcttggctggtcatcgttacccgtctccctccgggcctgcctgctccgctggtccgtatccagcatttccagtgattcgctccattcttcacatgaacgcctaccccctctctcgccctcttaaccccaggccaccgtgtctctgggcagcgcccgcctgacgctgctggtagaggcgacggacggcagcggccggctgctgcccctggcctccctgggcctggcagacctgtggctgggctactatgctacctcccgcggtgccatgtgcctcagcctggcgctgcccacgctgcaggttgaggacctgcggccctctgtggcgcccgagctgcggctggtgctgtccactcgctccacggcagcggcggcgctggcgtctggcggcgtggtgtcctctgcggccctgactgtgccggccatcagtggcctggacggcgccggctccagctccagccagctgcctcagccgaacccctcccttctgaccctggagtaccgcgccgtgccagccggcgtgatgccgcctctgccgccctccggcagtcagcagggagccaccagcaggggtgccgcgccgctcggcggtcctgctgcctcggcgccatccgctgcctctggcccggtggcccgcagccccgccgccactgcgctgcggttgcggctgcagcggcccaccgtggtggtggacttcaacgggctgctgctgcgcctggtgaacttcgtagcccccaatcccgtgttccagggcccggcgccgcgaccctttgagacccgcgacctgctgctgtcgccctccgccccctacctggcacaaggccgggacctgtggctgtcgcccgaggtgcggctactggcggacgccccgcccgcagccttcacagggccacagggcgcagctgccggcagcgctccggacactggctccggcggcgcccccaccacctacccgggcttcagcagcggcggcagccacatccacgtgtatgatggtggcggcgggcggctggtgctgccgcccgccctgccgccctccgagttcctgccgctcattgtggtgggcgcgggccgggcgctgcagctgcgcaatgtgcgcatcgtcaactgcgcctcgctgccgtcggtgctgcagctgggcgcgggggcgcggctggtggcacgtgaggaggacggcgtgaagatgctgctcgcggcgccggatgcagacaaggagtacgcggcagtgctggcggcggtggcggcggcggccgaagcggcagccgcggcgtccgcagcggcgacagtggcgggtggcacggcagcacaagcatcaggagggaccagcctgacagcgggcgccagtgtgccgtcaccaatcttcgaggtggcagtggaggcgctgggcgcggcaatccacatggtgggcagtgacggcgccgctgacggaggcctcggcggcccgggctcggccgccggtgcatcagcaagccgcggaggttcagctgctggcagctacagcgccaccctgagcgctgctctaggccagactgtgggctccggttcgttggctgcaggctcaggtgcagccggcgcaatggaaggtgcagatggcaccagcgccgtgcccaagacggtgctcaaccgtagcactactgacctcgcagctgccgctggcgataccggtgacggcgctggggtgggcatgggactaggatcagcgtttggaggcgtgggcgctgctgcggccaccgcggccatcctgtcctcccagcggctgcggcggcggctggtgctccagctggatgtgtccgccacctaccgggccgggggcagcgagcaggtggccgcggctcagttgcgcggcctcaccatacgcacactgaccacctttggcgggactgatgtgggcggcgggcttgtgcgtccggcggctggtgtcaccaggccaatgccgcccgcctccgcaccgctgtccaagaccgacagctcggccgcccacctgcccgacacgccgtcaggatgcgcagcaccggggccccagcccagctcgtcgctccgtgcgcccccgctgcagccgctgcaccatctggagcaccaccaccggtccgcctcactgaacaccacatacgccgggccggtgctgcccacccggtccactgccgcctcctactccgccggcgccgtggtggcgtccgtgtcggccatgctgctggagcccacggacgtgtccctgcgcttctccgccaccgccgcctccaccgacctgtccctggactgttccagcctgtctctgcggctgtcgcccgccggcctgcacctgctgctgcagctcaacgccggggccgccacccagctggcggtggcgcggccagaccagccgttggcgcgctgcgaccgcttcgagcgcatgtggggcagccacgacgccggcaccggcaccggctcgggcggcggggccacgccgttgcgtctggagctgggagtgggcggtgtggacgccatggcctcggagcgcggcgtgacggtgtggcggccgcagcccccactgggctatgtagcgctgggcgacgtgctggcggcgggtgggtagcgggggcgggtgatgggccttgcggagcaaatgtacattcatagctttctaacgatccgatcacttccgcgcacttccttcctcggtcgctttcctcccccaggctcgcaccagccgccaaaccaggttgccacagtagccataaacagcggcctcatagccttcccactggggtttacacgggtgtgggcatcagcgcctgggtactcgtctgcagcccctgcagcccctgcagccccctccacggcgctcaccacctcggcctcggcccccatggcctcccacttctccgccgatctggacactcggcttggggcggaaccggacgtgtgcgtgtggcggccggtgccgccgctcggctacgtggccctgggctgtgtggtaggctacggggcctcgccgcctgcactgggcgtggtgggctgtgtggctgctgcggctgtagtggagtcgcggcttggcgagctcctgctgctgggcgagggcggtggcggcaactggtggcgggtgcagaacgcggcttgcacattcgaggtgtcgggggcgcctgagggcattgctggtggcggtggtggtggctacctgccctctgtgccggtctacgacctccgctcgccactgggtgtgcccccggccgccctggtgccactgcctgggctgcttcccttcccctttcccggcctcatcgccaccgaccacctgggccgactggtggggagtggcgctagtgcgggcatccccaccgccctcagcacggtgctgctgccgtcgcaaggcagtatgcaaccagctgcaggcgcatcgggcggtatgccgaggcccggcaccaccgcatctcccccggtggtgcccctgggtctgatgcgtcagggcagtgtgccgctgggtgtggtgaccggcagtgcgccgccgctgtccctgctgtgccagcagcgctacctgaggtccaggaggtgagacctggggcaggcgacacaaagcagcctgtgcgcagcctgcctgtcttgcggccagcatgtgcagccgtgttgaggcgtgagcgcatggctgacgcaatcgcgtacacccacaggtcccagattagccgcgcggtgacccaggcctcccaggtgccgtgtgtggagttcaagaggatttggtgggacaggaacctggcgggggcggggccggccgcgccctcacagccgcacagccacctcagcatatggaggcccaggccgccagcggggtgagtggctgtggacgcaggggcagggtgcaacatgatgcgccaaccccccactgtgccgtgctccacgccctcgacccctcctgcctccccctggagccgatcacccctcctgcttctccctgcctccaccccagctacgtgtacctgggcgacacggcagtcaccggcatctacgcgccgcccacgtcggtggtggtgctgcgggacagcgacccagcggccgcactcacagagggccgcccgccgccactggcccgccccatcaactacgtgcgggtaagcgcgcagcagcaggaatggggctacctcggcaagcgttgtttgtattcacccaagcgtgtgtcgccatgcttgaaagtgtggctcccgccgacgtcacctacacactgcggcacttcccacccaggtgtggcatgacgaacaccgtgagcgcctgggcgaggacacgtatctggtgctgtggcgcccggtgccgccggcagggtatgtgccgctggggctagtggcgcgagtgggaccggcaccgcccgagccaggactgcccatccggtgagcgctctgagcaagcatatggtaacagtgttggttggcctgtgattacctcttgcgccacttgtagagcctctcgaccccctgcacatgcctgtccctccgtgcagctgtgtacgggccgacctggtagctgcggacgagctgcagcgcgcctcccccgactggttcgtgccggcgcacaagcagcgcatgccgctgtgcggctggctcacggaccgccgcaccggcaccttcacggtggtggtgcccacgccaggagccggcggcggcgcgccagctgcagaggggggcggcccccgggcagcggctgcgggcggcgtgggtgccggcggtgtaggcgccatgctgcaggtataccgcatgaagctggatgcggatgacgaggcgccacagccgccgcatagcacaccgtcgggccccggatccggcaaggcccaggcgtcagcttcaagcgcgtcagactcgccgtcattgccgcccgtgtaagtggcaaatgggtatccatgctggcgttcttcgcaattgtatgtatacgtcaactgtgttgcacaatgctcgaccacaagtgcatcccacaacgcggcccgcagttgtttgaccccattcctccacccccctacccgcccatcaccatcagttccaccaacctggagctgcgtctgggccgggccgcagtgacggtacgcacgagcctgggccgccccctgcttgagctggacgtgcgggaggcgcggatggggctgtgcacacagggcccagacgtcagccgcgggttcgccttcctcaccatgtccgcctggacgcactcgcccaccctgggcgtgtgggagccgctgctagagccctggcaggtgggttttgcttggacaggaacggggaacggcggcatgcgctgccctacccagcccctgtacatgatcgttggactgcatggttgtgagcgttgccagcatcgtatccctacttgtaattcccatgctcctgtgcctttcctgtgcagctgttggctcacgtggatgtgaaccgcgcctcccggccccgcggcggtgtgggaccgggcacctgggtgcgcttcacatccacacaggtgggcgggcatgaagctgagcacggccacggcgctactgccaacagagcagctccatgctgcccagctgctcgggcatttctgccggtacccactcccattgacgccgccactttccctcagggctcggtgcacgtgtccctggccgccagcgcattgcgctcactgctggacgcgctgcccgaatggagcagtctgacggggccggagggtgagacaggcgcatgggaggtgctggtgggctcgcttcctctcggcagtggcagtgcgcaaaccagagagcggatcctgatgtactcgcgtttgcatcgtgcaggcgtggccacggtgcggcggcagctggcatttggtgaggcaccagcgaatgcgctgggcggccaggtgggcagcagcggcgcgggcgggcctgccctgcagcaggggctggtgaccaacgcactgggctgcgaggtggcgctgctgacagacctcggcgatagacaggtaaacggatgcgccttttgtggcatctggctgtttaagtgcgtgcatcccaagctttctctatgttgtgatcaggctggccacatctgttgctgcggtgtctgcgtgctgactggtgacatgtgcacgcacattccacccgatgcaccacaggctgtgtcggagctggcgccggatgctgagggagtgccggtgctgctggcgccgccgcccgccgcgtctgctgccgcggctgctgctgcagagagccgcgccaccaacctggcgcctcctccagtgcccgccatccggctgctggctgatgcggtggccgcgaacgggctgtcgcctgagctgatggcggcaggggctctcatggtccgcataaaggtgcgttcctgtgtaccgtatgaggggttcgcagtttgcttgcagagcggaacgcggctttaaagcatttgatcataatcgctgtacccatgcaggtgaacggccccgcggcggagctgatgcccgagaccgcctggggcctgtacacccgggcggtggagacggccccgcctccacccctgcccgccccggcagcggatgaccccgatgatgccacgtgtgacacgcctcgctcctcagccgaaccctcttcggctgcctcgggagtggaggtggtgtggaacgagcgctttatcctcaagctacctgtggagctgagtgagcagctactgtgccccgcgcctggagacaaccagtttgccggtgtcccgctgcaggtgcgttgcaaggttacgctgtgctgtcatggtgccagaagcttttgtgtgtaggccgcagcgatgcccatgcatgcatcaaaactatctgcccttatgccgcgcaccattttgccgtttacggtcctggcagctggacgtgtctctgctggcatgtggctccgcgggcgggccgccccgtgtggtggctgccggcaccctgccgctgcagtccgactggttgaccaacgaggtggacatcctgcgcaacacggcggctgcagcagtggcagccgccacagcggccggcatggcggcccccctgctcaacgagggcggggtcatcaactcggccgctgctaccggcggcgccaccggctccgtgaagccaccccagccctcgtccgtgagcgagacgctggatgtgcccctgtacctggtcactgtgcagtccggcagcagcaggcagccccgcacgcagcagctccagcagcggcaggcgctgggcaaggaccgggggccgcaggagtccatggcgctcaagctgcgtctcagcctggacgtgcagcaggtggacagcagttgggcgcccttcctgtccaagtcaaggcgaggccggccgggtgccgggggaagcgcagcgtcagcagcgctcagcggggcgggtggggcctcgtctgcggttgctgcggccgctgctgcgcgcggtgggcgacgggctatccggctggcgggtagtgatgtgtgggtcccgttcaaccagacaggcggcatcatcacggcgggtccgggtggtgacacgcttcaggcatcaagtaagttcacattacttgggtatgctgccgtatcttgttgtgaacaagcgtctctgacggcctattctgcacatggtggactgcctgaatttgagcgcccaacccacctcacctacgcttcacggtttcctcctctgcagacacggtgcccatccgtgctggccccggcctggtgctagagcgcaccccgggccctggcggccagcccctggagctgcttcgctcgctggctgtcctgcacaactgcaccagtgtgcccctggaggtggcgctgatggcgggagaccccgaggtggccagctggatgctcctggcggacacacccgcgtccacgtcatcagccccaggccgtggagctacaggcagcaaggggtcccgtgccggcccgcctgcagccgccgctcctggtgaggcgggtggtgccagagggccctcgggcgagatatcagcagcacccgtcacagcaagtccaccgggcgcgctggctggtcggggcgtcaccgcacgtgcccagcagcccagcgcacagacacgcgtgtatcgcttcctgccctatggccacccgttcgcctacatggccgtgacaacgcccgtgcaaagcaatgatacaacagccacacgcccaaccacctatgctgctgccgctgcctccgcagccccaccggctggcagcctggcgcccgtggatgaggaggtgtatgagaaccagcgctacatgccgctcaggggctggggcgcgggcaacctgctgcctacggagcgcaagcgctacagccgtgccggtcacagctacagcaccttcccgctggtgccgctgccgccgggttgggaatgggaggggccgtggcaggccgagacagcgggtgagaggttcagtgtgtgtcaatagtccctgactaagctaaccaacacacgcccaaagcacgccccaccgactcgcacaaccagccccctgcgcacaacagtgttctgtactcccttggcctcacaccgcatccacgacctcctgcttcgtgccgcgagggccggtttgcaccgtgtattggttgttatgcatgcgatgaagcctgtctcgtgagccgtacgctttgtgcctgacaccgtgacagcaccgagcgcacctagtgtcttgcactgaaattacgtgtttgtcgtgtgtatccccgtaacttgccctccaccctcaggccatgtggaccgcgacggctggttctatgccctggactggccgctgctgaggtacccgcccacgccggagcaggcgcggcgcaaggtgaccgacctggtgcggcggcgccgctggttgcggcgacgacgctgggtgggtctggccggccgcggcaggctggacagcgctgcccggcggctgctgggcactgtgcgccccggtgagcggctgccgctgccgctgggctgggaggctgagggcgtggagctgcaggtccggccggtgctggagctgccggcggagcccactgagctgcagctgccgccgaggaacccggcaagcgcggggccaacgggcggtgacacaggcggtggcggcggtggtggccacgacatgactgttgcggaggtcaaggcagtgcacgagtggagctgcggccccacgggccagagcggcctgctcatgacgtgcatggacgagggcggcgcccgcctgctgtgctgcaggaccactgcggtgccgcagcagggtgcggaggatggcgccggcccgatgcaggctggggcggtagggccagcagctgcggcagcagtggccgcggctgcagcaggcggcgctgcgtccgccagttccgctgccaacagtgcgtttgcggacctggccacaatggcaccgctgtccgcggacatggctgtggctgcggggcagcagcagggcaggcagggcgagttggacccgggtcaagccgcctggctgagcgtgagcctggagtgcgaggcgctggtggccacccgggcgggccttaccgcggctgaggggggcgctggtgcgccaggcggcctggacaccctggtggactggcgcctggtggtgcggccgcccctcacactgcacaacacactgcctgtgacaggtgagtaccgtgtgcaggagctgacccacctccggtgcttgttttcaattcatgacctgcatgcgtatgcgccatgcgtttggacaacaggtcgctacgtggtgtgggagcggccgcgcacgggtggtccgctgcgtgttcggcagcagggccgtgtagctgcaggtgccactgcgcccgtctacaccgcggacatgcgcatgcaggtgggggctgcagtgacggaagggcttggactgcgactggcacgtggtcccgacctccacctcactgtaacatggccgcaggtgtttctgtcgtttgcgcctgacggctgcgagtatggcgaggcggagccagtgctgctgagcgacggctttatgcgcaatacggcgggggtggcaggtgtggcaggggggggaccagtcagggcaaggagagcactgcctgacacgccgcacgcccaacccataagctaaaccaatgcattccatgctgaaccacttcatgtgcagccgcggcgcgactgcccgatggcttccgctgcacctacacgcattctgcctccttcactccgctgcgtatcaaccttatccgcgacgtcgatacctccgccgcctcggggcccctggcctcactcagcgtggctgctcgcaaccctgccgctgcggccgccaacacatctggcggtgcggcgccggcacccggcgaggccgtggccggcggctacccgctgactgtgtcgctgcacgtgccgctgtggttcgtcaacgccagccagctgccggtcagctgcggcgtcatggcgctggcagtggagcaggaggcaggcgggccagcacggtcggaggactcagccatgggtctgccgcggtttgggccagtgagtatgcctgcccagctcctttgacgaggcagcgcactaggatagaagcatgccaactcgaatgagtcatggcgtcgcatctgtgtaccctcttccctgtgcggcaggctgtcaacgaccaggtcctgcgcatcatcgacaccgaggccttccgcaactcgccccgacccaacggcgccgtgtcggtgctgccgcgctcactggagctgctgtcctacccacccggactgcccaacagcatcatctacggcccgccacccagccaggaggccggcaacgcggctgtgcaagtggccatcctgctttccatcaacggctcgcgctggacacagcccatctacttgccgcgacctggggagcaggcgcagccgtccaagcggggtgtgggtggcgtgctgctgcccaatgaccgcatgctcatccgcgcgctggccaaggacggctgcattcacgaggtggctctgcgcctggagcccgcgccgctgtccatagtggcggccggagcaggtcccggggcagctgggggcgggggtgcgggaagtgcgggcgccaccctggtgcggctggaccaccacctggtgctggccaacagctgcggctacccgctgacactgctgcagcccgatgcggcggcggcggagcgggaccgggaccggacacgtgagtggccgccgtgaacagggtgtgcccgacctcgcgagcgtgcgcaaacgtgttacggacaaacctgctatgcggggcctatcgctaacttgctatggcgtctcccggcatgcagagtcaagccagtcgcgcgcctacggcggttcagcggccgcgcagcgctcgggagccgctcctgcacgcaataacacagcggcaaccgcagtcgggctcacaccggccttgacgctgcagctacctccaggtggggctttggctgcaagcgcgtgttggtcgcccgtcctgccgatatgtgtccgcgttgataggacctctcgttttgctctcatccgtaggtgcgctgggcagtccggtgcactgggccgctgccgccgctggccgccgcaagttctgtctggcgctgcctctggctggcgagacggctgcgtccgcctccgcctacgggctgccggccagtgtgatgtggagcgagcccatcaaggtggacctgcccggcggccaggacacgcaggtggggcagcgcagtggggacgcagtgagaccgggttatggtcacgttgctcattgtgtgcctacgtaccgtagccttggcgtcccgagggccgctcacagaacctgaactcccggctgggctgcaggtggccatcccggtgtactgcctgggtccggtggggcgctaccactcggcgcactcgtccagcccagccgcgggcgccatggcgaccatggccgccctggccaacatgacgccgcagcagcaaagggcgtttgagctgcagagggcgcacgtcgtggccaggcagatgtttgcagggctggtaggcggcgaaagcacaggccacgggagtggcatggaccgcgccgggagtgctggcaagggcccgcagccgcagggcagcggcggcacgggtatgctgctgggtccgggtgtggggcctggcctggcgctgttgtcgcagggcagcgacaggaaggatgccaagaaggaccacgaggagcagcatgccgccgcccggggcccgtcacggccggccctggagcccaacctggtccggctggtcaagagcactgacatcggcagcgtggtgaggcggcacaggggaggcgcagatgaagggacaacacgcggtacacggcaatggcggatgttaaacgatgttggtcacatgtgtgacatggttgaaatttgagatgctctacgtctatttctttctattgtcttgtcactcctccggaagcactatgtattcactctatccgggctgccgaagccaagcaggccgtgagtacggagcgcgtcctcgcggcttttgggcaaccctggcgccagctgccgaagggccgccgtgcccgaggcccaggccaaacatgtcgagagtctcgggacactgtgcgcgggacactgacgcggacccattgcgtgacaagccgcctcctaagcctcgcacattactctacaccatacaatatacacaaacgcccccgccacacagcctgaccattgcgggcgtgccggacactgtcttccctatgccgcgcttcctgccctttctcaggagtttttggctgtgctgcttaacgtgcgtgtggtgatccgggcgcccggttgcctggtgctctgggcggcctcactgggcggcctgccgcagcagcttatcaccaacgcctcgccgctgccgctcatgtggcggcagtcgcacccgcgggcagcatgggcacgtgtggagccctacagcgctgtgtcggtttgcaggggcgtgctgggcgatgggtggggctcgccacccgaggtggaggtgcgcgacaccgagccccagagcgagagtgagttgcgcagttgtgcacgggccggctacttgtaaagcgaagttggctacgcagggttgcctgaaccctgacctagtgcttttgctgccgcggtcctggccgcagacatgctgcttctcacctttgacaccgcctcgacttccacgacaagcgctggcggcccgtcggtgcggggcgccggcgtgactggtccgctaggtgccggagccgcgggtgacagcggtcgggcggttctggcaggcatgctgcgtgttggcgccaaccaccgcgagctgctggctcaggtgcggtcgataaagccgtcataattggacaacaaggacggttaagatcacgtccctaccagtgaagggcgcagtgtgccatcgtcagcgctgtggcatgctacatcgctactggcatgtctcgcaacatacccatgccgcctcgccatgtgcacccaggtggcgcccgcactggagctggtgctcacccctgacggcctcaacaacctgccgggaggcggagcggcaaaccaggggctgggcgcgtgccgtcttgatgcagcgctgaggatcgcgccggctccgccgcccattggcccagcgggtgccgggccccgcgctcccacgttcacagggccttacctcacgccagctgccctggccggcgtgtctcgcaacaaccggggcgcggttgcgggcgctggtgccggcggggcagcggctgcgggtggcgtgggtctaaacagcagtgtgcaccttagcctggaggtgggcagcctggagctcagcctcatagatgggcggccggaggagatcgcggtgctcacgctggacgggctgggtgtggaggtgtccacggggcggtcggctggctcgtacgacttctgggagctggggctcaaggtgcgcggcgtgcagctggacgaccaaacgcccggctcagcctacccggtggtgctacagccgctggacacaaccgcggcggcggcggcggcgcgggcgggcagcggcgagtgcatgttcgcgctgtcctattgctgccaggtgcgtgactgcaggggtgagcagtacatagcgggctgaaccacaatttaaacccggtaccacaattctggcgcctttcctaagatttgttcgtctttcctgtacccctccgcagcccggtaagatgcgctacgctctcaactgccccatcatcgccgcccgcctcctgcctctgcgggtgtctctggctgagccgctggtgtggcggctgtatgggcttgcgctcagcatcgcaccgcccgcgcccgctgccacagccagtgcagtgcagccgcgcggaggcggccgacaccaggtagggggtgcgggcaggtgccagcaggatgaggcgtaacatgtaggtaccgtattgccatgtgcgatatctgtcgccggctggcaaggttcacacatgcagctataagtgtgcctggtgctacacgcgccgtttacaaatattatttgcgatcctgctaggcattgctcacttctttaccttcgcctcccctgcccttttccgtccgtgccactcaggtgtcggccagtgacatgccgctcgccattgacctgatgtgggtggaggacctcagcctgcgcctgtccttccgcaccgacgcctccagccgcccccgctgggccagtggcggcttcatccgcctgggtctggacctggcgcagctggaggacctcgcgctggtgctgccgggtgagcgccaggcggcggcggaggcgggaagccaggggagagaggggaagatgtcgtggcggcagaggcaggcccccccccctcatggtcttgtatagagaatgacttacacgggaggtgggcctaccgacacaggtgttgcttgacgcctggtcatttccgtcaccgtccacttcgcaggtatcgagctggagcgcgtgaggatgccgcgctccctgctgctgcagcaggtcttcacgcggctacaggtatgggggtagctccgactggcctgcgacgcagtacggttgaggtttcccaggggtcttgctatttcctttccaatctctccaatgcgtcctcctacctctgcaatcccgcatgctcacctgacaggaccgcctgttctccatcgttctggcggtcctgcgcaattacggagtggtgggcggcctcagcaaggtgctggccgtgtcgtcacaggcagcagcgacacttgcagcggacggtgggggcagcggctcggcccgtggcggcgcggccgggggtgcagctggtggtggtgggggcggtccggccagtggcagcggcgaggtccgtaacctaggttccggtgtggtggagggcggccgcgccatcgcccgcgggctgctgcagggtgccatgggcatcatcacaaagcccgtggagggcgcggagcagggtggggtggcgggcttcttcgaaggactcgccaaggtaagattggggggtgcgtgtgcaggtttgaaagttgtaggtgcggattgtcgttagcgtgatggatgcaagatgcgatccaatggaagcgcgcctgccgtgctgcgaaacagtagcggatgctgtattaagccctcctgtcttgctcagggcatcgtcgctgcgcctgtgagcgtggtcagcggcactctggctgccgcaagcaaggtgacggagggtgtggacgccacgacgcggaatttacggggtgctgcagccacggctgtgggcgccaagaagctgggtgctgcacgcaagcgactgcagcgtgccttcacaggtgagggcgtcttttgctatacagcccagactaccatatgaccaactctgttagaaaagggttcggacgcacggtgttacggttgctccccaatggctgtgccttgatgtttgctgctgctgctgccctctcatgctttcctcctcctccccaggcgacaacatcctgcgccccttcaacttgcacccagcactaggccaagcgctgctctactcagtcgcggtgtggctgggtggcccaaaacccggcgggtcggccgcaggcggcagagctaccgctgcagcacagttcggtacttcgccttccatgtccgcagggagcggccgttccatgattggtaccgctatcagctccaccatcaacagcaccataggcgccctgcctgtgcacagcctgatgagcatgagcggtcgcgccagcggtcggcctgacctccggctggaccgctatgaggagcactgggtgctgccggggtccgtggtgctcatgattaccgaccggcgagtgctcgccatgcaggcgccgggtgagtttagaaccagggccgtcaaggaatagcctggaatggttgtgcacgacatgcaacggaaagccagtgtgtgtaccacaacacgtcgtgacatggctgttggctgcttgggcttatgtcctttcacagagtttgtggcactgcagtcagctgtcctgtccggtgagaccacccatgtgacggacgtgcctgtgggcgacgccatggtgttgtggcacctgccatggccagacatgctgtctgcggagctggcgtggcacaacaggacgccttccacagccggcgccagcaaccctgcaggcagcaggtcggcggcttcagcagcagcaacctctgtcgctgcagccaacccgcccgtgggcgctggtggcggctctgtggcgatgccggctgacgggctgctgctgcaccgcaagtacagggcggaggacgagcagctgctgtacgatgtgcgctgcaggtgattgggtgccttgcggcagcgggcgggcaaagctgttgtggctcagcttgtgtgaatgtcttgttgatccacatcattgcgtacctgcaataccatcttcttctacactcatgtgcaggcccgggacctcccaggcggcggaggtgctctcgcgcctccaggaggtgcgctaccgctgctatgtgctggcgcggcagcaggagcgcggctggcgggacaaccagagcagtgtgggcgtgtcgccggtggcagcagcactggcggcaacggcgagcgggcacccaagcagtggcactaggaccacagctgctagcggtgcgggcggcagcatcttgccagacaccatgatcagccaggagttcaagctggtgtggcgctccccaagcacccggctggccagcagccgcgcagtgtccttctggcggccagtggggcctccgggctatacaatgctcggggacgtagtggtgttgggccgcgacccgccaccgcggcctgtgcgcatgtacaaggacgcaccagctctggctgctgctgccgtgaatgccagcggcagtggtgatgcgccagcctcggagggcccccgcttggcgcctcctgtaggctggaccctggtgttccgcgacagctcgcagccaccgctgacgctgtggcgaccggtggccccgcgcgggtacgtggagatggggtgcatcgcctggccggagattgaggagccaccgctgggcctggtgcgctgcttacggcgggaccttgcggctccagggcgggtcttcgagagcgcagtctggggagctgccagctcggacaatagcttctggcgtgccagtgtgtggcaggtggatgcggctgcaggcacgtttgtcgcggtgaagggcgatgcaaagccggcacccgcgctggtgagggaggcggtgttctaa

SEQ ID NO: 49 - DNA, 9153 bp, Chlamydomonas reinhardtii
  misc_feature (4092)..(4191): n is a, c, g, or t
atgccgctatcgctccagcctgcccgtcaagggcttcgagcgcctgctaagcaggtgagttggctgagggaacgacggatggttggtgttcgtcgaccatgtgcaagcgtgcagagccgcgcagttgggacccagcagtgctagggagctgatggatgtgtatacattgcgcaggctcagcatgcgcgctccggaaagccagtcctgaacctgccgcgcggtaagtttcgggcgctctgcacttgccgaggctgagaacgagccggcaagcacctgtgccagccctgtttaccagcagaattatacaaactcacatcagaatgcatgacgtccagctgggagcggcgtagtgggaaccgcagaggtcccagcagaatgcgttttgtcttgtcgcaatcgacagcccgccgggtcgtcgccgtgcgcgccctgcccggccgctgtataccgccagacacaatctcccacgatccgcatcatacggggggaatccgctgcggcgatgggtgttgcgtgcgttcagctggcaagcacggctggcgcagaccacacaccgcgtctggcttccgcgcgggcgtgccgcgttggcagggctgtgcagcgtccaagctagccctgcaacaggcagccaacccaaaacagcgcaactcaacaccggcgcaacggccctccagtaacgtcagcccaggggcctgcagcgcccggccttttgctgctgcctgtgtgctgacacgcacaacgcctgaccgccgcacccgccagccgctgcgccatccctccttgcaccgcgcccaacttcccacacacgtccccggatcccatcacctcgtctcaaaccacctgcggctcacccacaccgacgcccgctttcctgttacatgcgcaggcgccacggtggctgccgcgcggtaccggattattgaggacccgcccgccgcgccgccgccgccgccgcccgccgccgtcgtggaggcgcccgcgccggccgtggcggatgtcgtgactgccgcgccggccagcgccgccgccgatgcgggtgcgtgctggcgggtgccgcgtgtcctggtcttggtgccggggttggtgtctgttgtggtgtgtgtggtgtggggtcgtgtgttccaaacccaactaaacccgagacccagccagcccgtagagcgcgagggaattgtgatcttaacctttgtctaggacgccctggagccttggtcttctaggcggtgtagaccgtagacagtaggctagcgactcgcttaccatcgagtggcacccaagctcgcggcgcgcggtaaacccaacccgctaagagcaaacagagctcaacgctctacaataatcacctgcggggtgtcagagcagcaccggcgccaggtcggcagcgggacgaacatgtggaacgtggaatgtgggaggcaagcgacgcgttagcgccaatgtggtaaagggtgtgggaccggccgcgtgcacgacgttgcacgtgtggcgtggtggtgaagggcaggccggcaggggtacctgaggactcattcagggctggaggggacgggaggacagcgtttcctgagtccaaaggttccaagaccttgaacagaaactagagctggggggggccgaatgcgccgcgggaaacggacgcagacccagcaggagaggcgggcggcttggtggggtggcccctcgtgccctggacgctccgcacccgctcccgctccccaggagtcatgggtcgagaggtgacattcaagcccgtgcctcgccgtgccatgtgctcaccaccgccggcaccgaaccacccatgcctgcaaccctgccccggcctgccccctgctccgcagctcccgccatcgctaaccccttcgccgccgccatggccgccgtcagcgaggcggcggagaaggtgaccgacgccgccaccgacgccgccgccgccgtcgccgacgccgcatccgatgccgtggacgccgtctccgacgtcgccagcggcgccgccgacgcggtcgtggacaccgccgccaccgccgccgcctccgccgcctccgccgtcagcgcagtgacggaggcggcggcgccggaggcggccgccgacgcggtgtcgtcggctgtgtcggacgccgccgccgccgcctccagcctggcggcgcagcgctacctggagatgaccagcaaggcagccaaggtgcggctgaggctgtgggctgtagccagagggctgtagcaccgggctgtagctggagggtgcctgccatgctggcggcagtagctgggctgcagttaggctgtcatggggccgtactgtagctggtggacgtctgactaagggacagaaacacgcgggcggcagtagctgggcagttgctgggcagtagctgggcagtagccgatgtagccaaggtacaaggggaagaagggaggtcaacgccgtgcgcgcgcaaatagcgtgcgctgtggctggggcgcagtatggggaagcagcagtagcagctggcgggttcagggcgagtgcgttgcggaccgacggcgtcacagcgcctcacaaacgcgaacaaggacattctctcattagctagacgggcaagtcaccgctcaccatccatgcccgttcttcccctccctttacacgcacaggtcaagcctggcagttccgctccttccttcgaggcgccctccttctccatgcccgacttcagcggcgtgcagctgcccaaattcagcgcgcccgatctttccagcgtcaaaatccaggttcccaagatctccctgcccgagtccgccggatccgggtccggatccgagggggccggcgccggcgtgacgctacccaaggtcgagatccccagcttcaagctggatctggatctgccggagctgcccgacgtcggcggcgccgccggcggcgccgctgctgacgtcagcgccgccgccgccgcggcggcggcggaggccaacgccgccgtcagcggcgtcttcaacaccgtcagcgcctccgtcggcggcgcggtgtcctccgtcagcgccaccgttggcggcgccgtcagcagcaccagcgccgccgtcggcggcgcgctggcggctggcgccgccgccgtggacgccgccaccggcgggctgctggcggaggcggaccgcgagctggcgggcgtgcggcaggtggggtgatagctggatcactgaagcgggggttacattcatggataattaagaagtgaaggcgtaggcaggtacagtagcggggggaggggtcgtagataccagcccaaactaaacctaacccaatgcaacagagcaggggggcttcgggtggtcgggaccgaagcccacatccaactaacagggggcaggggtgagaaaggcgaggtggctaatgcgaggcggatggtgaggccgtggcggcggcagcgcacccgcccatccatgcagctttttcccacctgtcatgctggtgaacttcgtgcctgcctgcctgcctgcctgcctgcctgcctgcctgcctgcctgcctgcctgcctgcctgcctgcctgcctgcctgcctgcctgcctgcctgcctgcctgcttgatgtcgctgccaggtggcggacaaggcttccgccgccgtgggtgccagcctggagggcgtgagtgcggccgtgggctcagccacagcggccgtgtacggagccctgcccgcgccggcgcaggtgagggggactggaggccaggagggaaggagggaaggaggagacgaggaggagaccaagaggagggaagggtcaagcagggggggggggattgaccaaggcaccgcaggggtgaactcagaaggtgtgcccggtatttcgccgccttaaactctgatcctatctctagtcctagtcataattctgtttcttacaattctgatttcgcctgcttgtcaggtgctggcccgcgacctgggcgaggtggtgggcgccttcgctgccaaccccgcctccagcctggtgctggcgggcctggtgggggtgccgctgggcgccaaggcctacctggacaggtgcgcagaaggggggggtgcaggtgcaggctcaagcagggggaggggaggaggaggaggaggaggaggaggaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggaggaggaggaggaggaggggggacggagagggcgaggcggggaggaggacgaggagagtaattacacttggtagtggcgaagccactgatgtctagggctgacaagccctagtgttaggtgagcgcgttccacacaggaggagagggcagggaaggggaggttgggtttgtcaactgagccaagacccagaagaggggagggcaggaggggagggcaggacaagcaggggaggaggaggaggggagggcaggagggggtggaggaggaggggggctgggaaggggaggcggggtttactctccaagccgactgagaggagatggggagatggttcctccttgcatgtacgacaacccgctactccccctcctggcccccctgctgctgctgctgccgctgctgcaggtacggcggctacagcggcgacttggcgcccgccgccgtgaaggagctgctggcgcgggaggacgcgctggtggtggacgtgcgcagcgaggcgcagcgggcggtgaggagggggaggggggggagagaagggggaggagggggttacattcatgattaattaaggagtgaaggcgttggcaggtacaatagcatagtagacgcgtggggaagggggaggggactgagacggggaggaaggagagggggagcggcgggagcgcgcggggtttgtctcaagccggggcctgtgcaggggcccggggccggggttgcagagctggtggaaaagcggtacaggatgcactgaagactgcaaacctcgtcagccacacactctgtcgaccctgtccccttgtgcattcctaacgcacacacacacacctgtacacacacgccccccccccacacacacacatacacacgcccacgcacgccctcacatgctcccgcaggagtcgggcatcctggatctgcgcaagagctcgcgctaccgggccgccgcgctgcccgccgactcggtcaccttctcgcccaagtgggccaaggaggtgggcgccagcgccgctcgtgctttgcgtgttggcgagaggttgggagttaagggaagcggagggggggcctgcagggtgtggcggcggacggccaatgccgagcccaaggcagccgaggcccaggccagggttcgaaggcagcccacacagagtggagcaggagggaagctgggacggggcgtgcgtcatggggcgcgtgagaaaccccaacaaacccctcccctggtctgcctatatccccccctggtctaccggctaccacttcctaactaatcatgaatgtaaccccccccccctctgcctctggtacctggtgttccacttctcttccctcactacgacttcgtcttccccctgcccccatccccccttcactcaactaatcatgaatgtaaccttcccttcgcttcttaatcaatcgtgaatgtaaccccccaacccccagcgcgccagcgacaagcagctgggtgtgctgacggcggcgctcctgatcgccaacctgacgcgtgtctccacgccgctcaccaaggtggtcatcatgaacgacaaggtgtgtgcggggggcgtgcgggaggggaagaggagagggggagaggagaggagaaggggagagaggggggaaagaggagaggggggatagaggaagaaaagggggaaagagggggggggcagggaccgacagcatatatacgcagcacgagcaaaggcacgcggcagatagcacacaccgtggaacgagggcttggacggctggaggcgagcggacgcgcagtggcgggagctttggcattgcttcctgtcgctgtcagccgctgccccacgccgcggccccccctcctttactggacatcggcgctttgtacgtgtggggtttgatcactccgtctttcgcttgatcattccgtctttcgtttgatcaccccgttttgatcaccccatccatcttatcactccgtcttatcactccgtcttataactgcgtccttcatggacggccgccctcccgcgcacaggatgacgtggcggcccgcgatctggctcgtgcggtgcggcaggcgggcgtgctgcgcgtgtacgtcatgggaggcggcttccaggtgcggaagaggggccgaggagcgctgtggaggggtgtgggtgggtgtggaggggtgtgggtgggtgtgggtgagggcaggaagctactgaagagggggcaggtggaggagggcggggcggggaaggaggcgttggggcggggaatgggcgataaaggggaaggggccggtaaaggtgggggcttgtgacgcaggagggcgtgtgcgcgcctggttgaagtcaggagcaggagcaggcgcaaggcaagggcccagtcaggcatctgggttcggttgcccagctgccgccaccgctgtgcatcccagctcccatgggctcacgcctggacggccgctcacttagtaacaacttcgtttgcagttttcagtgcatccttttccaaacattattgcaacccccccctgcgctcacaccgaacgtcctcctctgtctgcctcgcttggccccgtcctccttgcctctaccccggcactcacaggcctggcaggctgcgggcctgggtgtggtgtcgggccggaccgagtacgacgcctcggcgctggcggtgttcgcggacgaggtggcggaggtggcgggtgagaggcgcgcgggccaggggttgggaagggggagggggagaagccatgctgccgtgtggcacgcaagggcggggccggggccgggggcgggggcggggccgggggcgaggacagtgcagggcagggcagggcgttcttgcttccgagtaccgataccagcagtataattccccgccgcgccccctgcggcccccgctgctctgcccctgctcctgcacagccgaggtgacgcccaagctgaaggacccggccttcctcaccaccgcactggccacctccagcctggccatctacgcggcagccaactaccacaccaccctgcggtgagcgcgaggggagaggggacagggggtctacactcagggggtttacactcggggggtttacactcatgaataaaaagtggaggcgtagccaggaacagtagtaccgtatagcaggtgggttgttaccggggcgggcaggcggggcaggctgtgggcgggaagtcggtgttggaagggggttaaatgtccgtcggcggcaagtcggtgttggaagggggttggccgtccatggcgtcggagtgaatggaccacagcgggttagtgctggctttcaatggaggcagcccgggcgagcgaggcaagggaatggcaaagaaagcagcagtcgcgggcggggctgcagacggggcggggggtgtcggggcgcaaggcctcgttgggggtcagggatgcaggctggcgggcgggattgctcttggcgagaggaaggaaaggcgagggagcggcaggcaagagaggcgagggaacggcagaagggccgcggtcatctggtgctcacacactggtcgtgtttaggggcgtagtctggctgtggggagcaggggcaaggcggcagggcaagagcagggcgggagggctgcggcagcaatctggaaaggaagcgccacagtgtgggggcaggcaggcacctggccggcgcggcgcgatttgccgcctccgctgccttcggcgtgtgtcgtgtctgggactgtgggaggagaccgagtaccgcctgcagtccccacgcccagcccccggtcctacacctaacttgtcgtggctggcccctcacggcttgctggtctcgcccctgccgcctcacacagccctctcattcctccctcgctcccgccctccctccctcgcccctgccacctcacacagctatgtggcggtgtggggcatcatggctacgatctacgcccgcctctccaagtacaactcgccgcaggtaagtgttaggttttagcgatggagatgaagtggatttaatgaatatattgccaaccccgaacaacatacaaggccggaaagcagcccagggggaagcgaaagagcgaggtctcgccacagcattgtaggacatgcctgtgagctagggaatcgcaggatcatgccgcaagcagtttttgctccacgagttatgggataaccgatgtgtgcagaagacagggacgtggagtgacgccgtgtgtgccctgtgcatgcgtgtgctaccccccccccgtccgcagtcttcagtgcatcctgtaccgcttttccaaacatccctgcaaacccccccccctgcaggagttcctggatgacgtgcaggccggcctagccgccgcctccgccgccgcctccgccgccgccgccgcggccgcgagcagcgccagcagcgccgccgccagccgcgccgcggcgcccgccgccatcgctggcggcgctgcctccgccgcctccgccgccgctgcgccggccctggcggcgcccaagcccgcggcgcccaagcccgcggcgcctatgattgccccggccccggccaaggaggtgtcttttgacgccctggctgcggcgatggccgcggccggcgccacgccagcggcgcctcccgcaccggcgcctgcgccggccgcgcctgcgccggccgcgcctgcgccgcctgcgccggcggctgctcccaaggccccggttgccgcaagcgacacgaccgccagcgccgccccggccgccgccaaggaaaaatcgcctgcggctgcccccgcgccggcgaaggcggagccagcccccaagccggccgccgcccccgcgcctgcgcccgctcccaaggctgcggccccggcgcctgctgcctcgtctgcccctgcccccgcaccggcccccgcgccggcccccgcgcccgcggcggccccttcgtctgcatcggtccaggacagcaagctccaagtgaaggtgtcggtggccccggagggcaccgccagcaccagcgactaa

SEQ ID NO: 50 - DNA, 3677 bp, Chlamydomonas reinhardtii
atggagcgcaattacgcggtaatcttggactatgcagtacgcttcacttgcacacaagcttgagcttgcgtcgatgaagtcaccccgcgtcttctcgttgagcacacacagtctgctgctcacgctgctctctaaacatcgctgcaggggggctactctggaggcgggcagcccagcaacctcgtttcttcaggtgtgtgcatgcccgcggccccgcgttccctccgtgctcgtcgtggaagcgcgtgatggtgaaccaagccgtgattcattgtcagcaagcaagcctgacatcgctgccgcccgctgctttcatcccggggtctcacctatcgttcaggccggcgtgccggaaccgttcggaccggcacgcccgatgccgccccagcggcgggcggctacgcgggcgcaggggctgcagatgatgcggcatcgcaccaggcgcgcttcggtcggcgggcgtcgcccggagcctacccctccggtgggtgtgcgttggtaccagtatgtgtcacgcagcgctgcgtcattccttcatagtgccgctccctacacgtccctacgcttgggcaagtgacaccgtttctgcaccgatgattgtgtatgttcactgggtttatgtccaagcctgcaatgtaattcctcactctgttcataggcgggggcatggacatggagccgccccgcggaggagccagcggctacaccccatccgcggccgccggggcgccgcgcgcagccggcatcccacgctccggcgcggccgcaggcgcctactccgcctcacccgccgcgtcctcagcagcagcagcagcagcagcagcagcgccacccccaggggcggcagcggcaggacccagtagcaagctctcggggctgcagcgcctgaaggaggcggcagcgtctcgcctggtcagtcgcatccccagtggggggcggcatgcgcctggtgagtgaggaggctgcgggccgaggattcttgtgctagcaggtagcagcatgggttgatgtgcacatgtaacggatgtgggcatgcgtgccagctcttgtactgggtgcagggcgttttgtgtcgggtggcggacctggctagcgcgaactctctcaacccactaccggccttccccaatcctcttcccgcctctgaattccttgcagagtctgccgggtacgtgccctcagccatgacccaccaggccccggcccggcctgcgcccctgcgtgccggctctggcggcggtggcggcgcctcctcgggcacctctgctgccggccggccaccctccactggctcctcaggctacggctacagctccagtgctgccgccggtgcagccgcgggccggccggggtcgggccggagcgcgtccactggagccgcgcttggcgccggcagcagggcacccggggcgagcagcgggtacgggtatgggtccagtgcggcgggtacctcgtccacctcggcgagtggacggccgccgtcagggagcggtgccgcgtccgcggctgcggcgtctgcagctcgcccctcggccttggcgtcgctggcggcgcggcggcagcagacggcggagccggcagcggctccgccgccgcgggcgcctccggcagcggctccgccgccgcgagcgcctgcggcagcggctccgccgccccgcggcctttcaggccccatccgcgcgccgccgccaccagccccggcgccctcgtatggcggtggtggtggaggctacggtggaggtggtggctttagcggcggcggcggcggcttcgatgcgggtaccattccgccgggtgcggacgaccccggcccgacgggccccatggtggagtgcccctcgtgcgggcgcaggttcaatgagcaggcctactccaaacacgccaaggtacggcatcgttggtcttgcacgagattgggataggaaataggcggtacgcacgagcagggcataacacatcgctcgtcatgcgtggttgggatgggacggcgacaagaagacacgacaaggtggttacagctgaaacggcattgctgcgggcgcagatgtgctaggaatttccgggaggcgcttttgtgcttagtcccttaatcttgctgtcgccctcgttccgcatcctgcagatttgcgagaaggtgtttgcccagaagcgaaagccggtcaacatggcagctaagcgacttgagggtgagcttgggagtatggcggcaggcagcgaggaggttctgggttgtaaggagcgacggaagtggtcaggcaagggggctgccacacgaggcatgcacgacacgaacacaccagtcttccccagtcatgatggccaacttgtcctccccaacccttcaaccaaagcccccaactctggccttaccttgatctgtccagcacatcactggtgtcgcctgctcacccacccaaccaccacccaaccaccacccaacatcacccaaccaccacccaggctctgaggccgccaagttcttcgacatgcgcaagggggtgcccaagagcgaggccaagggggcggcagggccacccggcaaggcagcgcccggccgaggcgcgggggctgctggcgggacgcggctggacgaccggccgctccccgggtccaaggtgcgtgtgtgttgcggggtgctgagcggataggtaggtgccggctctggacaatattcgcacctaggcttgcgagcatggggttctcttcccctgtgatcacattaccaactgccactgcgcaaacgacgactgcaactgaactggctaggtgtcaacaccccacgtggttgtgcccgtcctgggccttccctccccttccgcatcctctcgtcctgtgcacctgcccatctgcccgtccgcatgcccctacccccagatgcccaagtggaaggcccagtccgagcagctgcggcaggccatggccgcaaacaagaggatcgcggacgcggcggctcgcggcgtggacatcaaggtgcggggggccgcggtatgctggaaatcgcggagcggtgggcctgggccaggggccgggttgcatgggatggtgatagcacggggcttccgcgttccggttggtcagggtgagctcatctgaatgaccagggggggggggggggggcggccaaggaggcgttgcatgacgggcactcactcggtgtggccggctggggacacataccgtatacgtgcagagagatatcgtaaagcatgagcgctgttgatatgtaaaaacttacgtttctacggtactggttccgcaggatgtcaagttcacgcccacgcccgcagagcaggacgaccggtgggtgtggggtggttgggtatggttgtggtgggtgtgggcgtggtgtctcgcggagtgtgtggacagggccacgctcggggcacagcacgcgctaggtttcatttgcgtccagcgcgcacatgccacacaagccccgcctcttgtcacttcgcgtcctcgttacggtattgatgatgctcgtaacctcaatctgtcactcactctatccatgccctgccctttatcaaacccttcacagcgtgccctgcccgcactgtggccgcaaattcgcggagctgaccgccgaacgccacatccccaagtgccgggacatcctggccaaacccaagttcctgggggcaaagagcggacgcggcgcgcacgtgcgccggtag

SEQ ID NO: 51 - DNA, 2072 bp, Chlamydomonas reinhardtii
atgccttccaagcgccctcgctccgggcccgccaatgtcaagccgactccaacggagctccatgaggctgtcttgaaatgcactctttgcaacaagctcatcgacccagtggatgactaccggtgagggcctgtcgcgtcacacacgtcgcgtgtgctgaggtgctggtcgtttcgcgaagcacgtttgtcctgtcattgattccattgttcaattcccttgaatcccttagactcagtatggattcttccgtgagcgtacgtctggttgccgccgttgatttcgcgagccatctctccctcaactctgcctgcagagacatactactaaccgtgtgaaaatgctgaccatcaccgtaggttgctggactgcggcgtttgcaatcgtgacgacaattgtgtccacgaagactgcattggcacgtacctcaagaaggaaggcagggaccaagctcagaaggtacgtgagcgcaggggtgtaacctgcattgtcgatgcacagtaggctgctcacaagtatatttgctctgggctcgcacccttgtgcggcacgcaagtgtggggattaggccattagggaacgaaaaagcacctgcgtgccaaatccataacacaaaatacatgctaaactcccttcttccccctgctatccgccccctttctgcgcagacgggcttcaagtgccctactacacttgccaatgggaagtcctgcaagggccacatctccaaatcccatccccatgtggcaagcaatgagaagaagaaggaggcacgcagggccccatcacaaccccgccacaactcgaccccccatggtggtgccactaaggccactgccaagggctctgttgtccaggctgtcaaggctgccatgacacagcagcttgtggtcaagccatcatcaggacccagctccacccgcttctcccctccccttcctcctgcccaaccaagcaacaacttcacgctgggtgacttcttcacctgggcgttgcctgctgccccttctgccaccaacacaacgcctcctgcccctcttcctactaccacaacctcctgtggcaatgtctggctggatcgcacccgccaggcttatgccaagggcctgactgtcccccagggacaccaggcccagcaggtggtcagtgcagagacacagctcctgcagcagctgagcgagcgcagtgaggaggctgaggacgcggttagctttgactctgctaacgagagcctcactttgtccgccaccagtgacagcacctccagcggcaccagtgtctccgtccccagcagtgccaccttgtgcatgctgctgggcaacctgtccttggatgcgcccacactgctgggcagccctggcaaccttggctcccacctgccttctccttcaatggacaagccccaggttcaggagctggtggtgcaagagctggaccaggtcagcactgtcatctgcagcaaggtggccagtgtcaccaccatccgcaacctgatctgcagtggccagctggcttggctgacacccgtggccacagaactgcagcaggtcatgatggcagcggcaggtggtggccaggtgctgtactgcagcctcatcaatggtgatggcagcagcagccttcccaatggtgacacaactgaccccattgtggctgtgcagcctgtctttgagctctccatcacccccaccagcctgcccagctgtcccatggctttggacctgacccagaccatgggtatgaaggtggttcgtgacccttgcaccctggcctgctacaaccctgaagactgttttggccctggctacagcctggtgggcttcaaggtgctcctgcctgaggccggtgaggagatggagggttccaacagcagtgtgtccaagcagtctgtagtggcccagggtgtgcctatccgccgtagccaaatcctggcagcaggtggtatggccagtgccagtgaggccccccaggtggccattggtgccaccccggttagcacccagtccttcctgactgagtcagatgatgagctggctctagagctaggtcgcctgtgtggctgcagctgctga

SEQ ID NO: 52 - DNA, 930 bp, Chlamydomonas reinhardtii
atggccctggacgcgggtgtgatgtcggtgacgctggagtttgccaaggacctgaaggacgcggactggttcggcaagtgagtgtttacttgcgtccgtcctcgcgccatcccgttgcacaacgggcgtccgcggcccggccccccgccagctccccgggcgagccccacctcccatgcatatgctgagaaggttgaaatggaagcgttgactctaatgtctcatgtgctctgagccgggacgccctttaggagcgccccttcacgcgctatccgattggcactcagccctcttgcctcgttacccggctcctcgccctacccttccaggcaagacccctactgcatcatccgcatcggtggccagaccttccgcacgcgcacggccgtggacggcggccgcaaccccgtgtggaatgacacgttccgcttcaatgtcatcaacgagaacaacgtggaggtggagatcaaggacgaggacgtgggcaaggacgacctgatcggcacgtgcaccttctcgctcgccaaggcgcgtgagagcggcagcgaccgcatccaggcggctgtggtcagcaagaagagccgcaagcagcgcggcttcctctccatcgccctcacctgggaacccaacaaggcgctcaagcccaccgtcaccacacagcccgccgcgcctcactatcactacatgccccacgccgcgcccctgcccgcctactacgccgcacctcctgcctacgccgcacctcctgtctacgccgcgcccgcaactcccatggcctactaccccagccctgcgcctcctgccggctactacgcacccgcgcaggcgcccacgtacgcggcacagccgccgcctgccgcagctgcctacccgcagcagccgcagcagccgcagtacgcgttttatcccgctgtgcccgtcgggcactag

SEQ ID NO: 53 - DNA, 1034 bp, Chlamydomonas reinhardtii
atggccctggaagccggtgtgatgtcggtgacgatggagttcggcaaggacctcaaggatggcgactggttcggcaagtgagtattaggctgatttggggacccctgtctatggggcgtgcagggttggcaccatacagctagtgtgcagtgcggggagtgcacaggggcagtgcacgccgggtcgtgtcgagattatccgggaaggggcctgatcgctgacttgggcgagtcgttggaagggcgcgtttagctgggaaatgcatgcaagttcagcgcaatgtgggcgcctcgtgcctcagcagcactcaagtaagccatgtcttggaggatgcccgcctggcatttgacgtcgcgtctgcttgcctcccaacgccgattcgctcatccccctctccgcatctgttgtctggcacttaaccctgttgtcctcgtcccggctcctcgccctgcccctccaggcaagacccctactgcatcatccgcatcggcggccagaccttccgcacacgcacggccgtggacggcggccgcaaccccgtgtggaatgagacgttccgcttcaatgtcatcaacgagaacaacgtggatgtggagatcaaggacgaggacgtgggcaaggacgacctgatcggcacgtgcaccttctcgctcgccaaggcgcgtgagagcggcagcgaccgcatccaggcgcctgtggtcagcaagaagagccgcaagcagcgcggcttcctctccatcgccctcagctgggagcccaacaaggcgctcaagtcaaatgacaacgccgccgccgcccacgcgccccaccaccagcagcagcactaccagcaccccccgccaatggcctacgccgccgcacccccgcccgcctattacgctgccccgcccgctcctgcctattacgccgccccgcccccggccgccgcctactaccccgctgctgcctacccgccggcacctatggccgcataccctcctggcgcctaccctccccagccttacccgggtgcggtgccgccgggccaccggtag

SEQ ID NO: 54 - DNA, 2069 bp, Chlamydomonas reinhardtii
atggcagccaagccaggtagcgcaggcggtgcggccccaccaccagcggcacccgcgcccccgcctgtgctggagaaaaagaccctcgcggagagccggttccttcggttcgtgaatgtggactacgcacggccaggggacaatgccaaggcaggtctggggctttcggagagctgcgcacttcaaagccgtgaacccgtgcccgcatggccgaagttaagtggacttgcgctgactgaacgcctttgcctgccgtagtcttcatggcaatacgttgagcggacaacgcgaaggggcgacgtagatggtgagtttggcgcggctgtgggccccgtcgcggcagttcccgagcggggtttgctcgccggttcggtgccccttgtgtctcgcagcactctcaaggggctgtagaacattgcttacaatctgctcacttctggaacctgtgtcgccgaatgcctgcagcggtgaacattttcgcggtcctgaaaaagaaggacggcaaccaccaagttctggtggtgaagcagtaccgtcctccgatgggaaagcataccatcgagcttccagcgggtaagcctcaaattaggtgcactgcctgaagaatgctgtttccgacaaaacgaactgaggcgttaagtgcgtccgtatcttgtgcacaggtctggtggacaaggacgagtcgcctcaggtgcggcgaaagggggcggttgacgggacatgcgagcttttcgttccgcacgtctgctgacgcgtgcctgagggctccccgaacgccatgtgcccggtagcatccatataggatggggggcgctggacagggcatcatagctatgccggttacctgccagctgcggccacgctacgccccaacgacctgggcagtaccagtaccgcgaactgacctcagcgccctgcctgcctccctttccgactgccccccacagacggccgcgctgcgcgagctgaaggaggagacgggctacgtgggcaccttcattggcgccacgggccagcaggcgctcagcccgggcctgaccaacgagaacatgtgcgtcacagcagggggcgggggcccatgggtgtttgtggtccccgtggcggccgtgtaagcttccggtcaggagaccagcaagtgcgttcctgaatcatgacaagctgtggggtaatataggcagtgatgggtttgcgttgatgaaggccacagaacgtcacccgtttgcaagcaccatatgcatcccccccccatccttccatgcatgtgcctggtgcccgtgcttgccctctggactgccgcttcggagcacacagggtgagtgtgaggttcggagttggaatcttgcttgagcaaagcacgagcagcactgcgtctctcaagacgggcacgctgctgctgcgctgaccgctctccgcgccactgacacgccctgcttgccccgccatgctcgcatgttgtgtgattcctctttttgaatggacgccaggtcaccatcttcgccgaggtgagcacgtggcaactcctcggatatgctactggctgcgctgcatggggttagcgccgggggtgggagtaggtacccgcacatccgacaaacgatgcctttgttgcgcagtgggcctcttgcagccagccgtgatcgaccctgttgctgccggcctccttatttagtcctgttgctgcctcctccttatcttgtccttgtctttctactccagattgacccggagctcccggagaacaagaaccccaagcagagcaaggaggaccgcaagatgggcatcacgcgggagtggctgccgctgaagaacctgcaccacacgctcgcggcctacgaggcgcagggctggggcgtcttcgcaggtgggcacttggggcggtaggacagggcggcgcagggagcgggcgtggagcagcagcagtgttgttggtactgctcggcctgccgcgccgcgcagttttgccatggcgggcacaagcatgcagcgaccttacgtttctcgttgacccctgcacaggcctgtacgccgtcgcgcacgggttctacctgcgggaacggctggggttgtga

SEQ ID NO: 55 - DNA, 1883 bp, Chlamydomonas reinhardtii
atggcttttcttcagcgactaggctctggtattagggatggtttgtcgtcgttgctaggcggcaaagacgagggcaagaagcacgaagtgggcaatgcgtccccgcagaggacgctcgcaaaaatcagcagccgtggaaatcgaccttcttccgcggcagtggggattctagagagccacacgcgcgaagccatcgccacctacgtgcaggcgaagtttgacaaggcaagccctcgctgtgccctggctccccccctttggcgccctgcaccacacgaccgcagcccaacccccgcccatcgcacccctttgctccctcatccccagggcgaggcgaagccgcacatgttcacgcagttctggctgcaattccccaagctggaggcggggtttgaggtgctgcggcgtcaactggaggcgcacacgggcagccgcgacgggccgctgccgctggcgctgctgcggacgcatgcctccgactttgggctgccggcgagctgcgccgtggtgcaggacctgtgcagcaagtcggctgtgcacaagtgccgcgacgtgagtggccttgcgcttccatatggtccggtgtctgggggttgggtcagtaggcacggaggagggttgtcatggtgccagctgaagtccagttaggcgtgctttaggcaatgcaggttgcattacagggaacattaggcaaccactatagccacgagcgcgacgcagcagcacaggcctgcagccaagccggggaactgggccttccacatatggacaccccaggcctcctcacacgcaactcgccctcgtctcctcctccctctctgtgcgcagctcgactttgtgggcctggtgatgctgttgctggtggcgcacctgacggagccggccgccacctgcgccagcctgccggaggacgtgcgcaccatgctggactgcctggagctggcgttcacgcacttcaacagcgcgcgccggggcaagctggacaagcgcgaggtgaggaggcggaggaggcgtggaagggaagaaggcggttgagatgcggtttggaggcgggtggaaggcggaggctgacgggtagcgggcttgaggagcgcggagctatcggctgggttggaggcggagaaagcgcctccacgtcgcttggcgttcatgccacctggttgggggactgaaggtgctgttctctgacggacaagacacgtgccgctccccttgtggttgggctcccgcatcacacacgtgtggcgcacctaccgtacctgcaatacgctgctggtgccgacccggtgctgccgacccaccccaggtggctgaggcgctccagtacgagagcgccaaggcgcacatcaaggagggccgcggcggccgcaccagcaaccgcctggcgcacaggctgttcgaggggctggactgggaggtgggtggcgtgaccgctggagacggccggcttgaatcacgggtggcggtgggcagagacagggcagagtggcacagaagaggtttggctgccggagcccaatgcaccccgtggagctccgcgacccagctctgacctgaccccggacaaacgctggaatttcccctccctgcagtacgacaacaccatttcgttcgagaacttcctgcggggcatcctgcagctgatctcggatgagttcggggacgacgacggcgacaatggcgacgagtacgtggtgctgacggagacgggcgaggccccgccggacggcgccaagcgcagcggcagcgtgcccacgacaccgggaggcacggcatcaggagggtcgccaggagcggcggggcaaccgggcacaccggggcgggtgtggggtgcgagcgcgagcggcatgggcggggccgcggcgccagccaatgtcgcgtaa

SEQ ID NO: 56 - DNA, 3612 bp, Chlamydomonas reinhardtii
atgtctaaccgcgacaagctcgcagtggtctacctggtcaccaacacacactttaagtgtaagtgggtatgtatcagccacatcagggcattttggctagcacgtcaacctccactgtcgccttcacagcaccccaccacccagcacgacccaaaccccctgatggtcgcttgccctgcgtgtctctttgcgcctcagccaccgaccgcattgcaatgctcgctgcctcgttacggctggcggaggcgcacgtgctgcccaccacccccgccatgttttacatcttcacctcccccgggtctctggtggagctgcggagggcgcttcgacccctgctgcgggtaggtgccagggcacgggccacgggttcgggacgcaacatacgatagccagataaatgcaggcagtcgcaactctagcgaaggaaagagtactagagtagttacgggaggcgccttgcatagtgagttggcgggccgcaggtgcaagcggcacaggcgggcgagagaacggcagtaccggtagcaaggcttgaggcactgtgcgcctgtgcccgagtggcgaccaggcctcacccccgcatggcctcaccgcgcccccacatggccgcgccgcacactgctgtgcaaggtgctgagcatacgcttccccctccccttgtgccgttgcgtgtgcgtgcacaggcgtctgccgacagcggccacatgcaggtgctgccggttccggacgacagctggcagctgccggaggcgggcaacgacacagcctactggcacgggtgggaagggctgccttgacgacgactggaagcgcagtgaagggtttttacacatggggtgttcaagggagtccttccacacacccaaggggcaacaactgtgcaagtgtgtactctgccacgctgctctgaataaacatttgcgggtttgggtgggagctgtgccctgccgcaaagacacgggcaatggcctagcgggtttcatgacacgccgtgtgtgcttgcggccgcttgctgcccccaggcattggggcaagcactatcgcctgatgggcgactggcggctgagcttcatgccgcgattcgccagggacatgggccaccggtgaggggggggagggaggggtgcggggtctggaggcacgtgtgcgtgtatgcgtatgtgcctgtgtgcacgaggtgggagcgggtgagaggtgtggggcccatcacgcggccgcaatgattgttggtttcggcttaccgtacagtacggcactcgtccctgccactcgaggcaacgggcttgttggctgagtgctgcccagcccaagtgcaacggtcgcggccgccttgcagccttgctggtcacaccaaaatcgcgttgacaaacccgttgcgggcaggtatgtgatgcagctggatgacgattcctacatcatcggcaaggtgagcctgtggtttgggaaaacgcatgtccttcttcaggatcaagaccctgtgaccgcgacagcctttgccaggctgtgaccttgaggtgctgcgttgggtaaccgcgcccacgctgccaccgcccgaaatcaactctaaaactcgggcacaagcagctcagcagcagccgtactctacatggccacttctgacatctccctcatccgcattgcggtccccacggttccgtctcgataggtggaacagaacctggtgcagctgtttgactcgcgcaacatcagtctgggggctcagaaggtgctgcaggactggccgctggtcacctggtgcgtgcgtgtgtgggtgtgtgggtgtgtgtgcagcgtgtgtgcgggcgtgtgtgcgggacgtgggcaaatgtgtgggtggtggcgtgggtgggtggcctgaatgtcgggaggcggcaggcgcaggcaatgcgggcgtcggctgtggcttgctgcgtgctggctgaggctcgtgctcagggcttctttcgtggagccaacaaccactaccagctctttttcctcctcgggtcaggcatgagaggctgcggcgctcgtggcgctccctttccacgcccgctccactaaacgcacctaaaaccaaaaccctaaacccctaaaaaccccacacccctgcctccgctccccgcccgtcccgccgcgccttgccgccctcctccccactccttcccccgctgacctctagcccccttccccaacctaccgcatctccacgccacgctgcaggggcctgcccgagctggccaagtacttcctgttggcctaccagctgcagcccaccacactgttccagcactgccggccgcccgggctggacggactgtactcggcgctggaccaacagtcggtgagacggggtggcgctgaggaataggggtgctggggaatgggggtgctgaggaataggggtgctggggaataggggtgctggggagtaggggtgctggggaatgggggtgctggggaatgggggtgctggggaatgggggtgctggggaatggcggtgctggggaatgggggtgctggggaatgggggtgctgagggcggcggggaaggtcaacgggtcaaagggtccagtggtgcggtggggggagggggcggggggcgttggaccggcggtcagtgagagggggcggcaggggcgggtgctgagggcgctgaggagtgagggtgctgagggtgctgggtggggctcgtgggccagggcttagaggtcaggggttgccgggatgcggccgtgcgggtggggcgatggcaggggtgcgccatgtgcacatcacgtcaccgcatcccgccgcatcgacgcatagtccagggaacgagcagcgggcgggccagcgaagggtggcgccataaacaatcttccgagcatgctcgggacctctcaaccctacccctctctctttctcgggcctcagctgctctcgctccaccctcttctttacccccattgggcccgggcacataaacccccgcagctggatgcagacccggaggcgcgagtgctgggcagtctgttccccaacaaggccgtccctcgctcgggcggctgggaccgcaccatcctgaacggcaactgcgtcatgatcagcctggacttctggttcagcagcctggtgcagcgcttcgtgcagctgtgccgcgccagcggcgggtccgtcatgtaccgatggaacgagcaggcggtgctgggcatggtggcgcagatattcgcgagccaggagcagctgctcatgttcagcttcccgtacgcgcacaggtgcggtgggggcggggcacggcgggggcgttgcctggtggagttgttgctgctcacgggatggggtggggtggggagccgctgatcacgggatggggtgggatggggagccgctgatcacggcatggggtggggcggggagccgctgctcacgggatggggtggggtggggaactgctaatcctgcgggtgggctgcggtagtgtggtgtcatccgcgacaggcaggtggttggctgcgtggggcagcgaagcaaggctgtggcaccggcacaacgctgtgtgcgcgcccaacccgtgctgcgtgtgctcgcttgcgtgcacgtgcaggctcaagtacaaggacgcgttgagagcaggaggcttaaagccataa

SEQ ID NO: 57 - DNA, 2081 bp, Chlamydomonas reinhardtii
atgggactttggatatctaaactgtggtcgctgttcggggaccaagaagctagaattctcgtgctcggtctggacaacgcaggcaagtccgggagcccctggtaccagagaaacatctaatagataggctaactgtaatggggcgcaaaacctcagtagggtagctgcaaccttctgggatgatcgagcaactttgcctaacccgcaagtccgctgcaccgcaggcaaaacaaccattctataccggctccaggttggcgaggtggtatcgacaatccccaccatcggtgagcagtgccgctggctcagtcggctcagcgggcacccgcgggtgcgggacacacgggttcacctgcgactgcccgtccgggcgcgtgcactggaggtgcgacgcgccagccccggtaccagccgcttacaaagggcactgcaaccatcggcttcagccctcctcgccgcgcccttggcgcttcagtgtagtcgcgctcttcgggaacttgccgtagcaaatgccagtcatagggacgtccgggaagcttggtgctcggcggctgccgcgccactgccccgcaccgcactgcgctgatgcggtcgccgtacggtagtgtcatcctggccagctgcgctggctgtgtgggcctggggcgtcggcgtcacgtcagtgtctggcacgcagccagcggacgcgaccaaacatgaccggaaccggaggcaaacacacgcgcctgctctggagctacaccagggcgccatgggggagggggcagcagcagcgcagcggggcatcgtggcggcggggacattgtggcgggttcagcggagcgcctcaacacggggtgggggcagcacatggacctacccgacgccacatcgctggggtgtgtgggacactcgagcggccccaccgatgcatctgactcctgcccttggcacgcatgtgcgccgcgcaccaccacgccacgcaggcttcaacgtggagacggtaacgtacaaaaacatcaagttccaagtgtgggacttgggagggcagacctccatccggccctactggcgctgctacttcccctgcactcaggtgcgggctgcgcaggtccacccgcgacctaggtcagggtggtgcaaggggggccttcacaggcaggctggcttgttggggcccccactcaccaccggcagccgcgtgcaggaagccaagggagaagaggcaggccagcagttgttggtcatgcttgcaatctgctcgtgagagcgacgcctgggccgtactgtgggcctcctcgctgtggctctcgcccactttccttaccacagctgtcatgcttgccgctcctcgcttcagcctccttgttgccctcaccctgcccccctcaccctgcccccctcaccctccccgcttcccctgcccccctacccgcgccctcaaggccatcatctacgtggtggacagcacggacacggagcgcatcggcatcagccgggacgagttcaaggcgctgctggacgaggaggagctgcgggacagcctcatcctggtgttcgcaaacaagcaggtgggcagggggcgggggtccagcggggccagcgggaggaggagcggggcggtgacagggcgggggcgtgggcgtgggcagggcgaggccagagcgggctcagggagggcgtgacgggcgcttgagcgggttgttattggcagcggctgtgagggttgaagggcgggtgaaggctggcagggcagggaggggcggtgtcataaactcataatggcagggtgctcccagccgcagcccgcccgtgtcacggtcgcggctcgtgccccgcacctgaacccttacacgcccgtctgaccaatgccacaatctattctcctctgccgctcgtactccctgcgaacgcccacgtccgccgccgccgcgcaggacctgcccaacgcgctgagcgacgcgcagattgcggaggggttagggctgcacgacatcaagaaccgcgactgggccatcttcaagacgtccgcggtcaagggcgagggcctgttcgagggcctggactggctggccaacatgctcaagacgcgccggaaatga

SEQ ID NO: 58 - DNA, 10759 bp, Chlamydomonas reinhardtii
atgggcttgtttcgccgcgcggacgggccagcagtggtcgctgaggcgcatcggcacataccgctgggctcaagcctggacacagaggagcacctgccctaccgcggcaactatgcctccacaacgaagtacacgttgcttacgtacctgccgaaggcgctcttcgagcaatatcggtgagcgtgtcgacaacggcgtgctgttcaggggcctcggcgccgcgggccaccctcccggactgactggggctgcgtccgcgaaagctggtccgactttcgcaaccaggtctcataggcaatgccccggcaacagcaccgtaggatagtctcccctcgtggaggcagggggggactggcttttgtccgggccgtgcttccgggccacgcgggctgacacgcggactacagtggcgaagtgactgcacttgttgctgtggccgaatgggtcgccccgggaggcctcaccacgccagcctgcacccaggcacctgaatctgagccagtctgccgtgtcagctgcagccctggcgtgcagactcaagccgtgcaccgcacgcgcccgcaggatacagcggcgacgcatacgttccttgcattcctaacaccgttaattctgcccttgccgcctgcaggcgtgtggccaacatcttcttcaccttaatggcggcgctgtctctcacgcccttcagtccgctcaggtgcggtacacgccaacagctgctgcgccacgccgcacgtggtgcttcccggtagtgcgcttcgaacgcagaagagctcgtgctcaagatgtgtgcgggctggcccggcaaagggctgggccagaggtggccttggctaacggcggcatgcctcctattcagtcctcgcgtagcgggagcagccggaagcgccgtgggtaggcgtggccgtgatgtgacgcctagcgagcagcacggcaggggctcggggaccgtacgtgccgctgcggccgcatggcagcagtgcggcgcaacggcggcacgggcccggcatgacctgtggccgagccgcagcagcgccggtgaaggggaacgcggacgctacagaaagcagggtgtggatgtggggacagctagctgcgcttgagcaccagggaggggcgcagaagggcgtgcgacaaccaggaaacggccacatcgccgcttgcctgcgtttcccccacaaccttataagcaagcacgcactgcactgtccacacacgcacccaagcccccgtgcatgtctttctgttgacgtgcccggcccgctgcaccgaccaggccctggacatgctggacgccgctggtgctggtggtgggtgtgtccatgatcaaggaggcgcgggaggactacaagcgctacaagcaggacagggaggtcaatgagcggcccacgcgcgtgctggacaggaagaccggtgcgtgtgcgcgtgcgtgtttgaaagagatgactcagaagcgcgtcgctggggagctgggggcaggaggcaggggcatggctgcgctgtgggtggtggcccggcctaggcgggttggtgtcttggtgagcttctgctacgcatgcctgggccgaggtgtcacgggccggcaggccgttcgcgccctggaccctctttgaccgccaaggcacgaacccttgtctcacgctttgtatgcccgctgcggccagctgctgagcctagcaagtgtatgtacagaatacaacactgaggggtgggcagtatgtgggatatactggggcggggcggcgggaggggagggcgagggccgttcgaaccgagacccgcctcccgaggggggcgggttgaggtgaggggcggcccgaacccgacccgaccgcatgccccgcctgagcatgccacaatgcccacccctcaagggttgtaagtagcttatacactggaatgggacccgagggcaagcaaacagtctcagcaacacgcaagaacgaacgcaattcatgattttaagctggcggggcgggcagtgtgggggcggggcgggcaatatgggggcggggcgggctatatgggttggtcaaatgttgacgaaccgccacatcgtgcgagctggggactaatggactgcgaggctgactaaccatgtattggtggtcagccatgtaacaacccagtacgagatgtattttgggcaagtgcccagtgcccgaggggcctcccgggttgtaacctaaacgcatatgtccccgcaggtgaatttgtgacgataccatggaaggcgctccgcgtcggcgacatagtgcaggtgcgcacacgcgtgctcgctcgctgtgtggcgttgtcctggggtgtaggctggacctgtgctgcgtgcatttgtgacatgcggccccccggcactttcgctccttcgccgccctcaacacgccggtgatgcctacatacccaccgtgatacatggggcgctgcacgtgtatctgtaactgttgcctgtagctgtagctgtaaccataagtgtgtgtatgtgttgcgtatgtgtgcaggtgtgccgcgacgagtacctgcccgcagatctggtgctgctatccacctccagcgatgagggcacctgctacatcgagacgatgaacctcgacggtgcgtgaggggccgtgcatagtggggcctggtcccgttgccgatcccaagcattgcatgcgctcgtcccacttgctcccaccatcgacgcaatgtggcacggcggcaaccgcggtggtcctcccgtgcaggcgagacgaacctgaagatcaaggccgcgccggaggagacccgcagcctggaggaggccgacctggtgggcctcaacgccatcatcgactgcgagggacccaactcgcgcctgtaccagttcacaggcaacctgcgcctgcgggcgccgctgccgcccaccgtggtcgcagccatggcagcggcgcaggccatggcggcagcggccaaggcggcagccgccgccgaggccggtggcggggaaaaggaaaagctcgagcaagaggggccgggttggggccgtgcagcggccaagagcctgcttgcgaatggcatggaggcgcacgcggcgacccttaagtctatggcgtcgacaacagtcgccgcgtcggagcccagtcgatggaacttccgtgcgtcgcagcggcgggccagcacacgcgtggagccgccgcacgagtatgtggcgtcactggccgcgtcggcggtggtgctgcgcggctgcagcctgcgcaacaccacctgcatctacggcgtggtcatctacgcgggtgggtggcgcgcgcgcgcaagacggcggggcggctggaggcggcgccgcggcggcgggcgccgtggatgggagggctgcggtagcccgaaggggcggaggggccaatgcctcgccgtgcggtgctgggtgccctggttgccatggccggggccagcttgcgccctggccgagcctacccccgagtctttgagtggataatcctgtctgggcccacttattctatagctctttcgttcgcgccgcggttccaccaccgattcacgcacctcaccaagtctttcatgaacggctgccttcccgcccaccgcatttccggcacgcaggccacgacaccaagatattcatgaactccaccgaggcgccctccaagcgctcctacatcgagcgaaccgtggaccgcatcatcctcatgttcttctgcgtgctgctcatctggtgagcggggccgacggcgcgttcgggaccggcacatggactggcgggcggactggcggtgtgggctgtcagtaagcgggtgtgctcttccaggcgggcatgtgcacggtctgcagcaccagcggcatggcatgtccacagatggcatatccacacaacattctggccttgcgcctgactccaatgctgcccatacccctgccgcctgccacgcaaaggtgcctcatctccgccgtgtaccacgcctggtggaccaacacccacttccgccagcactggtacatgcgccccgacgccctggacgccgactccgatccggacaaccccgcacagaccggcgccgtcaacttctttgtggcgctactactctacagtgagatgcggcgctcttatacacgcacgcacaccccacagcagcactcaccgggtctacttgctagtctgcatcattcaaacctggtctggcgcttatcgcatgccggcatgcgtcatctgaccaacggagcattcagattctgtggggaatctactttcacgccgacccgctgccgttgcgcctcttgtgtcctgcaggctacttggtgcctgtgtcgctgtacgtgtccatcgagatggtcaaggtgttccaggctatggtgctcattgcgcaggtgggcgccgccgcagcagcagcagccgtggccgccgttgcccgctgctatcgcagctgcttgtgtgctttgcgccaggtctcagacctcagcaccccatgcgcacgcacgttctttcgcgccgcgttttccccaccaaaaagcagcgccgtcgtagcgataccgtaagttccaatgtaacggacctttgccaatgtgttcgtgccacaggaccgcgacatataccacgcggagacggacacgcccgcgctggcgcgcacgtccaaccttaacgaggagttgggcatggtggcggcggtgatgaccgacaagaccggcacgctgacacgcaacgtgatggagtttttcaaatgctccattgcgggcgtgccgtacggagcgggcattacggagattgagcgctccaacgcgctcaggtgtgtttgagcaggggcacggttgggtgggcgacgaggggtataaggatcaccaacaaaagctgcgtaggcgcgccgccgggctgaaatcggggcgtgtggggttcggaggcgggtgctgcggccgcaggacgaagcctggccgggattagctcggcgtggatggggcaatcttgtaccttgaaccttgccattttgcaatcgccactcactggcgaggctagtaagaggcctggacggccatgccgagactggtggttgcagcccagcccagttgcttattattcattctttcttctgccccaccctgcaggaagggccaggttctggacgaccgcgagcggcccgacgcggccaagttccgcgagcgcttcttcaacttctacgacgaccgcctgatgggcgaggcgtggtacagcgccaaggaccccgtcaccatcgaaatgttcttccgcctgctggccgtgtgccacaccgtcatccccgacggccccacggatgagaagagcatcaagtacgaggtgagcgccgagcaaccgcactggacgccgcacccaacgggcttcatggggcatgtggcgaactggcagggcggtctgttaggaggaatgactggggccaacatccactgctgagaaggaccccggtaccctcgccttctgccccgcccgcccgctttccaccacccaggccgagtcccccgacgaggctgcgctggtggtggctgccaaggcgtttggcttcttcttcttcaagcgcaccaacaccaccatcacggttcgggagcgcacgccgcgcggcaccacggacgtggagtatgaggtgctgaacatcctggagttcaactccacccgcaagcgcatgagcgtggtggtcaaggagaaggccaacgagaagatcatcatcttctgcaaggtgggcgggggcgtgacggtggaaacacgctgggaagctgatgaacaggatggggcaggggcggcagtggtggcggctcagtcggctgctgcaaatgggcaagaaagccacaacgggcatgacgttgtcgtgtatgactttcctagggttgtctcctcttgtaacatcgcgaacatgatctgcctaaactcggacgcagggtgcggacacggtcatctacgagcgcctggaccccaactacggccccaacgaggacgccaaacaggccacgacccgtgacatggaggactttggagcgtccggcctgcgcacgctgtgcctgtcgtacgccgaggtggaccgcgactggtacgacgcctgggccaaggagtgggacgcaggcaagaagtctctcgacgaccgcgagagcaagctggcggaagctgcggagaagatcgagcgcaacctgcggctgctgggctgcacggccatcgaggacaagctgcaggagggcgtgccggactgcatccggatgctggcgctggcgggcatccgcatctgggtgctcaccggcgacaagatggagacggccatcaacatcgggttcgcctgctcgctgctcacggaggagatgcaccaggtagggcgaggcgcggacacacggtagcgagggactgataggcccaattgtggagatgttgacgagccggagcaggtgtgtgtgcgtgggtgtgtggtcgtgtgccggcgtgcgcaagtgccagcgattgacactgatccctgcctggaccgggctcgcctcttcggctatccgcagcacacggtcacggcgtcctcggcgcgggtggaggagctggaaaaggcgggccggcggcaggaggcggaggcgctggcggcggagctggtggccaagcagctggacaaggtgagtggcagctggagaacaggatgtgcatgtgtgggagggagggaggcgttccaagacaagcggcagcgcaggttacgggcaccgcctcccgtggctcctgcttacgaaatattttgatggcaatacccctgtttacaaacagattgacttggagctcaggcaggctaccgaggcggcgaccggggcagccggcaaagctggtggcgccggcgcggggccgaagcagggcggcgctggaccgggcatcggcggcggcatgggcggcgatgccattgacgcggcgctaatcatcgacggaaaggcgctgagctacgcgctgtcaaaagacctggcgccgctgctgctgcgcgtgggcctgcgctgcaaggcggtggtgtgctgccgcgtgtcgccgctgcagaaggcgcaggtgacggggctggtgcgcagcaccggcagcatcacgctggcgatcggcgacggcgcgaacgacgtcagcatgatccagcgagcacacattggtgagtcaccaggaagattcaagacttgagcacttgaactgtttatgctaggtggcttatcagtgggaggcaggtggcagcaagctggccatggacgggactgagttaccggtattcccttttgccccgcaggtgtgggcatcagcggccaggagggcatgcaggcagtcatgtcggcggatttcgccattgcgcagttccgctacctggtgccgcttctgctggtgcacgggcaatacagctacaagcgcatcacgcgaatgatcaactttttcttctacaagaacatgctgtttgcaataacacttttcacctactcggcattcacaactttctccggctcctacatctacaacggtgaggattgctcgggacgcttcccttgcgcctgcgcctgcccgcagcccacatcgcaaccgtgttagctcacttcctggacacccgcttcccccacttccgcatccatccagatctcctgcatacgcacactcaccaactacgcaactggcacataactccaacacctctcgaacgcccctccttcatgccctccctcgccctgtccaccgcaacacacacacacatacggtacacacacgcagacacgtccatgacgttgttcaatgtggcgttcacgtccgccacgccgctgctggtgggcatgttcgaccggccgctgggcaagcgggccatgctgcggtacccgcagctgtaccgccaggtggggtgtgggtggccgggcggccgagtgggtgtgggtttgcgcatgcatgatgttgtgcacgcccaaccgcacacgccagctagtgtgcacaccgctggaatgaagaaactatggaggaggatgcccagaagcgcatagggcctacgcctgggccagggcggctagggcgacggtacacgccgccgtgccataccctgctacttgcccccaccttccttccgttgggctcaccgcgcagggcattgccaaccgcgacttcaacgccgccaccatcctgggctggatgttctcggcgctgctgcagtccggcatcatcctggtgctgtgcctggtgggatgccgcggcaccaccgcctccgcagaccacggcatcccctggagcatggccgaggtggggcagcgcgcgcgcgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgaatgtgtgtgtgtgtgtgttggtgtgaaagagcacgaggaaagcaagacgttgcgtgactgccggtctggacccaggtggaggtggcttggtggcccgaccgcagctgcggctgagaatgtagccttgcagcacgccggccttgcggtgccgcctgcagccgtccgaattctcacatgccgagttgggctgacgccgcacgtgctacatacctgagtgtgctgcctgtgtgccgccatgtgtgcgtgcctgtcttgcacgtgtgcgcaggtgggggtggtgatgttcacgtcgatcgtgctcaccatccacctgcacctcaccatggtggaggaggcctggacctgggtacaccacctggccatctggggcagcgtgggtgagtcgcgcatcagcatgaccccaaagtcccaaccctgggcctgggacttgccctggagcggcactgccgcgcgcttgtgccgcgcgcttgccatgcatcacgcgtaggccgaccctcgcgttgcttgcccacacccgcaccctgcaccacttgccccttaatgcacgcgctggcggtaaacccgtggatctcaatttccaaacgtcttccgccaacatgcacgaatgtcttccccccaacctgcgccgcgccccgccgcgccccgccgcgccccgccgcgccccgccgccccgcagcgctgtggtacctgtacctggtggccttcgcctacttccccgtgtcgtggagcctggagatgtggcacctgttcgagggcattgtggcgcccaacgcccagttctggctctacagcctgatcatacccgcggcggcgctgctgcccaacttcgccttccgcgccgtcagccggtgcgtgtgggaggaagcgtgggggctgctcagaggactggggttgggaggttggcacgcgggtgctgcgtttgtgcagtgcagagggttggctaaggacggctgtaggtcaatagagcgcggcggcttggggcgctgcacagctgtggctttacaatgcagcggcagggcggctgcgcgacttgggagcttgatgctgctgcaccaggggggatatccttgttgtcatcgttttgctacaactaacgtcttccgcgtttgcggcggttgcaattccgtttgcctatgcaggctgctgtggccaagcgacgaggacatcatccgtgagatgcagaaggtggagcgcgcagccaacagcgactcctcgcaccgcgccggcggcgcagctggggccgcagccggcgccgccagtgagcaccacgccctgcagaagcacaagggcggcggagggctgctcatggcagcgatgggcagcggcagcaaccgcgtagcgcccgagccgcccgcatcgccgctcggtggcggcgcgcgcggcggcggcggcgccggcgtcaagtcggcggcggcgattgccgtggctgagggcgggccagggaataagtcgttcgcggtcacggcggtcattgctgctggcggcgatggggctggcgcgggcggggctggtggtgggaagggcaagggcgggcggtggagcgcgactgggcaagatggcgttgaggagctggatggcgaggaggccgcagacgacgtcacggcggcgcctccacagccgccccctggcgccctgacgggcacccggagcagccgcgacggcaaccccaacggcttcagggtggtcggcaacaaggggcctggctcgacaatgcactcagcaagtggtaatggctcccgcgccgcaagtcgagcgggcccgtcaccctttgcagcggcgctggctccgccgcctccgggcgcaaccagcaacaccagcgggctagatgagctgacgctggtctccgccgacggcggcggcatcgacggtgccgacggcggcgccgatgggagggagtcgccgctgcttggctcctttgcaccatccccgacgcgcagcgtcgccggcccgagcgtggggcatatccccatcgccggccgcagccgaaccgcgggactgcccactgtgggcagctccacgagccttgtagggggagcgggtggggtgctggcaggcaacgggcaccactcgcagcgcttcgcccaccaggctcacctaccgcatgcggcgctggcgtcgtccatctcgacacccgtgcttggggaggacggcggccgcaacaacagcgggacgggccgcgccgctgcgggcgcgggcgcgggcgtcgggccggggtcaagcgcaacggcgtcgccgcgaacgcaggccgccgttgcgcgggggcaggcagggaccatgggcagcaggggcggcggcggcggcggcgagatgcagcctacggcttccatgtcgggcgggaggatggtggttggccaggcgtccggccagacgggcgacagcgccagcggcgtgcgggaggtgtctacattgtcccgggcatcgtcgtcatcggtgcagggatag

SEQ ID NO: 59 - DNA, 6611 bp, Chlamydomonas reinhardtii
atgccgaagggctgtccctccttccgtaagaggacgggcacggaggagacgaagcgtacagtgcacataaacgcgagtcaccatgagcacctggagctgctccaccagcactataagggcaatgccacttccaccaccaaatacaacgtctggaccttcctccctaaggcgctctttgagcagtacaggtgcgtgagctgcgcggggagggcgcgcttgccatgtgccagaaggtggcgctcgctcgacttaaaagagaaaaattctgctgcaggcgtgttgcaaacatctacttcactatcgtggcagcgctttcgctgacacctttctcgcctgtgcggtaaggtcttcgttggggcgggcgctcccaagcttcgatttccttgcctaaacccgcgcttttctgcagcgcgtggacgacatggacgcccctcatcatcgtgttgggcgtggctatggtcaaggaggctgccgaggactacaagcgctacaagcaggacaaggaaatcaacaaccgtgccgtggaggtgatggacccggccaccggccagtatgtcaccaagatgtggaaggacgtgcgggtgggggacctcgtcgtggtgacaaaagaccagcagttccccgcggacctgctgttcctcacctcggagacggaggaggggacgtgctacatcgaaaccatgaacctggacggcgagaccaacctcaaaatcaagaaggcccctgatgagacgaaggacctgaaccagatggacttcgcgtccttcaagaacgccaccattgagtgcgagggccccaacgcgcgcctgtaccagttcacaggcaacttgctgctggacgggaagaccctgcccatcagccccgctgccatcctgctgcgcggctgcaacctgcgcaacacggacaaggtggtgggcgccgtcatctacgcaggtcagggtggtgcttgggtcaccggataggaggtgttgggtggcaagaggtgtgcggcgttctgtagtacggcatcaacccggccgcatcaccacgggttcaaacaaggcacagcctccttggcaacaagatgcagccaccattactccccgcgcagactggcactgagctatttgatccacgcatgacttacaggccacgagactaaaatctttaagaacgcggcacccgcgccctcaaagcgcagccgcgtggagcgcatcgtggacaaaatcatcttcttcatgtttggcctgctgttctcgttctgcatcattggcgcggtgtacttctccatctggacggagaagaagtcgcccaaccactggtacgtgggctcagccaacgccacgggccagtacgcgcagtacgcccccggcaacccggctttcgtgggcttcgcctccttcatcacctcgttcatcctgtacggtaagcagacagcggttcgtcgtgggcaaaatgggttggggtgctcaggtccgaactggtgttgccagggcacggaggtgcggactgttgtgcaaatcagcttcagtgcaagagtgctgacgttgtgggattgaggcactgtaccagcagcgcggcgctgcagacttgagccagctgtgcggggctccggtggtggtatcaaactcggtcgcactcgcatgccgcaggctacctcatcccgatttcgctgtacgtgtcgatggagctggtgaagattgcgcagtccatgggctatatcaacctggaccgtgacatgtaccacgcggagacggacacgcccgcgctggcgcgcacgtccaacctgaacgaggagctgggcatggtgaacacaatcttgtcggataagaccggcacgctgacacgcaacgtgatggagtttttcaagtgctccattgcgggcgtgccgtacggggcgggcattacggagatcgaaaaggcgaatgcgctcaggtgtgtcaggggctggagcacggtcgggtgggcgacgagggaaataaggatattcaacaaaagatgcttttgagtggatgcagcgtgaccttagcaaggtggcggctggtagccaagcgcaggctcgtgaatcttgccatgctgtcgtaaacacttgtgagatggacagaagcggtcaggagtcacaggccaatcctggtgggagcaggcgttgggtgaaagccggtcgcatcgtgggcacttgaacgccttgccatgtgcccctcgcgctctgccctgcaggaagggccaggttctggacgaccgcgagcggcccgacgcggccaagttccgcgagcgcttcttcaacttctacgacgaccgcctgatgggcgaggcgtggtacagcgccaaggaccccgtcaccatcgagatgttcttccgcctgctggccgtgtgccacaccgtcatccccgacggccccacagatgagaagagcattaagtacgaggtgaggccgagcagccccactagacaccggacccaacgggcttcatggggcatgtggcgaactggcagggcggtctgttaggaggaatgactggggccaacatccactgctgagaaggaccccggtaccctcgccttctgccccgtgcgccctctttccaccacccaggccgagtcccccgacgaggctgcgctggtggtggctgccaaggcgtttggcttcttcttcttcaagcgcaccaacaccaccatcacggtgcgcgagcgcacgccgcgcggcaccgcggacgtggagtatgaggtgctgaacatcctggagttcaactccacccgcaagcgcatgagcgtagtggtcaaggagaaggccaatgacaagatcatcatcttctgcaaggtgggcgggggcgtgatgatggagacacgctgggaagctgaaggagaggaggggccaagggcggcagtggcggcggcttggtcggatgctgccggtgggcaagaaagcaacaacggcactacatgaacgtgcacatacttccatcctttggacgcccagggtgtcccctcttgtaacgtcgcacacgttttctgcctaaactcggacgcagggtgcggacacggtcatctacgagcgcctggaccccaactacgcgcctaacgaggagatgaagaccacaacctcacgggacatggagaactttggtgccgcaggcctgcgcacgctgtgcctgtcgtacgccgaggtggaccgcgactggtacaccaatgtgtggatgccggagtgggtcaacgccaagacgtcgctggaggaccgcgaaaacaaggtgggcgaggtcagcgagaagatcgagcgcaacctgcggctgctgggctgcacggccatcgaggacaagctgcaggagggcgtgccggactgcatccggatgctggcgctggcgggcatccgcatctgggtgctcaccggcgacaagatggagacggccatcaacatcgggttcgcctgctcgctgctcacggaggagatgcaccaggtagggcgaggcgcggacatacggtagcgggggactgataggcccgctttgtaatttgtgctgtgggccgcgtggcattgccaagcgtttgtggcttctgagagcatccgtgcccatcgtcctgcagttcaccatcagcgtgtatggcgtggaggagattgagaaggcggagaaggcgggcaacaaggagctggcggaacagctgagccacgcggcggtggccaactccatcaaaacggtgagtaccacaaaggggtccttcctggaagcactagaggcgctacgggatgaccttagcccacttttgcacgctgtcgtctgctgtgctttggcgtcaggcacattgtaaaactccatgcatgcaaacacagatcgaggagaccatgacctccaagtcggagggctcgcgcttcgccataatcatcgacggcaaggcgctgagctacgcgttgtccaaggacctggcggcgggcttcctcaagatcggcctgcgctgcaaggcagttgtgtgctgccgcgtgtcgccgctgcagaaggcgcaggtgaccaagctggtgcgtgaccacggcgacaccacgctggcgattggagacggcgccaacgatgtgggaatgattcagatggcgcacatcggtgagtgatgttgccatgttggcgattaaaagtgtgcttctggcgaggtgaggtaccgtctgtgggcttcatcgtagtagcgggcacgcctatgctgagtgctgaagctactgtgtgatctttgctattctcctcatgttgcggcaggtgtgggcatcagcggccaggagggcatgcaggcggtcatgtcggcggatttcgccatcgcgcagttccgcttcctggtgccgctgctgctggtgcacgggcgctacagctacaagcgcatcacgcgcatggtgctgttcttcttttataagaacatgctgttcggcgtgaccatcttcgtgttcaacgccttcaacgccttctccgggcagtttatctacaacgatttctacatgacgctgttcaacgtggtgttcacagctctgacgcccgtggtaatcggcatcttcgaccgcgacgtggacaaggccatggcgctcaaataccccggcctgtacatgcagggtgcgtgctgaagcagtgacgtacgggctgcttgcacgtctgcagcaccaactgcctgggcacggtccgctcatctcattcatccatagcactgattctcgccctgccttgccgtggttccgtcacaacccgctgcccctacaggccagcgcaacgagtacttcaacttcaaggccattgcgctgtggctgctgtcgtccatgtaccagtgctgcgtcatcatggtgttcgtgctgatcggctgcaactccaccgaggtggaccgcgacggcggcaacccctacaccatgtggcagacgggcgtgctcatgtactcgtgcgtggtcatcaccgtgcacttccaggtggtgcaggtcatcgagcagtggtcgtggccctaccacgttgccatctggctcagtcagagtgagttgcgtaaccctgcggcgagctgggcagaaccttgaccactacctcacacccggccaagcggcttcatgctgcggccaggtacagcactgagcgaacacactcaccactgaccaaccttgcacaccccgcacgtgcctggtgtgcacctgcagtcgtgtggtggctgtacctgctggcgtacggcgccttcccgctgtacttcagctccgacctgtacaacctgttcgtgggcatcgtggcgccgggcccgcagtactggctgtactgcctgctgatcccctgcgcctgccagctgcccgacttcttcgcgcgcatggtcaagaagtgagtgttggcgcggaccagttggctgggcgcacgggttccgctcgcggttgtcttggtcccacgatgagtgcctgcttgcgcgtgtgggcgagggctgcgcatgccgcctgcatgtctggatgcggcaagcctgcaacggctgtgcttgccactggtgacgctgcaggctggtgtcgccgttcgaccacaccatcgttgcggagatccagaaaaagctgcagcgcgccggccgcagcctggcggatgagaggggccaggagccgccgtccatccttgccggcatcttcagcggccaggccaacaagaaccgcggcttcgtgccgccctacgacccccgctccaagtgcgtgcctgaaactgggctatgccgagctgaccacgcccgatcttgtgtgcacgctccctttgcttgggcattctctctcgtccctaaacatcttccgggggcgtgcttgcgcaggttctacgggctggtcagctctggggcgcgcaactcgggccgtatcgacacgggcgtgcgcaacccggtgctgcaacacctggaccaggagctggcggacaacccctaccgctccggtcgcaagaaggggctgccggggatatcgccaaagtgcgtcggggatgggggatgggcacagaggtgcaaacgctgtagcattgtgtttgctgtctgggcgcagatcgcggcctcggactgtgtgtaaccttcgcatcgctgcttggttctgctgcaggggatcatctgccactgccgccgcggccagcgccgcgtcggccggcaacgtccagccagtggcggctgcagctgccaatggtgccgctgacgcagcggccgcagctgctgccgctgctgcggcggcgaccacggccacggcagccgcggtcgctggagcggctccccccgctgcgccgccgccagcagtaaggtccccggcggcgcgtgtgctgccgccggttatcccgccgggcggccaccccaacggccgcgcacccggccggctgccgcccatgggcacgccgccggtggggctcactggcgcggataccatgccctcgaacaacagcgatgcgcctgccgccagcagtgtgcccatgccgccaccgccggccgtgggcttggcgcccaacccacgctccaagaataagttgccgccgctcatccacggcggcgcctcgagcccggccctggcggccacggcagcggcggcgccgggtgcgattgccagccctggcgcacctgcactggccccgcccgccacggcgaacccgcaggagcgggagatcttggcgacatacacagacgctctgcagcgttaa

SEQ ID NO: 60 - DNA, 3841 bp, Chlamydomonas reinhardtii
atggcacgtagcacgtatgatgactttatcatcaaggagaaaattggaagcggcagctatggcgtggtgttcaaggtggtgcgcaaggtggacaagcacgtctacgccatgaaggaaattgacctccagggcatgtcccgtaaggtgcgtggcatgcggtgatcgttggagacgggcgggggcgccacatccttcatgccctcgcctacgcaggagcaagaggagtgcattcgcgagacgcgcgtgctgtcgtctctggactcggacttcatcatccggtactatgactcgtttcttgagaaggtgtgtcgacggcctttgcaagtgcgggctcggacggggccccaccgacttttgctgtcgcgcagggcaagctctacatcatcacggagtacgcagccaacggcaacttgcacgattacatcaaaaagcaaaagtcccggctgacggaggacctcatatggaagctgtatattcaggtaggcccgcccgcgtgctggatgctgctcgctactcgccctactgaactcccctcgcctttgtgtagatcctgctgggcctcaaccacatgcattcaaaaaagattctccatcgcgacattaagacgctcaacgtcttcctcgatgaggacctgaatgtcaagctgggcgacatgggtgtggcgaaggtgcgtcctgcgagcgttgcgggcctgtgacagctgctctggttgcctcaaacggtgtgagctcaaccacggggcttgcctgtgcagattctgagcacaaacacggtgttcgcgaagaccatcgtgggcacgccatactacctgtcgcccgagctgtgcgaggacaaaccatacaatgagaagtcggacgtgtgggcgttgggagtggtgctctacgagtgctgcacgcagcggcacccgtttgacgccgacaaccaggtgaggaggaaaggagtgccggggtgtaggggtggtgggcggtggtacgtggtgggcgtgccaaacgtgtgctgggaacacacacgccctcgccttcccttcccataaccgcggcacctcacctcaacggctttgcctatgcgtgccgtgtccacctactgcagggcgcgctgatcctcaaaatcctgcgtggcaagttcccgccggtgtcggggtactcgccagacatctgcgacctcatcaagcgctgcctcacacaggtgcgcgctgcctcctcaggagcatgatagggagcacttcccgcgtttcagttggttcagctaggtcagcagccattcctgcggacagcccagccgtgtcggtttctagggccgagtgctgtatgccctgaacccggtcgctcacacgcgatgcgcagaacgccaaccggcgacccaacacctacaagctgctgctgcttcctagcatccggcaaaagggcgaggagctgggcatctcgctgcccgaccaggccagcctggcgctcatggcggataagaacatggcgaacgcgggcgcggcgggcaaggtgcgtggccgggcaggaggagcaggccgggctgcaggcgggccggaggacgcgggtggagtggggagcataggcagacggacaagtggattccgcatggagtcccggctgggtggggggtctgcatgttgcggaagctagagggatgccgtcggggcgtggtgcgcgggtgtacaggaccggggctcctcccagctacgccccgactgactgtgctcctcccactgtttccggtacggacgtggcctggtgcggccgcgctgctctggacctggcgtggaccgtgcttgcgagcaggcggcacggcccaagacgccacaaggtgcggggcgcagtatgcgagcaggggaaaggcgacccggctacgtgggatgcctgtcaaaatgtggttaggaagcggctggatgcgctgtgaaggcaaggaggccagactcaactctggctatggggcccagtgggcatgggcgcggaagttcccaagcagcgcccgcaaagtggacgtgaccgatggcgccgggccaccggccgtgcctgcctgtgcgttcaggcgccggcggtggcgctgcggtggtgccggtcgagcatgcagtggccgtgcgggcggtgcgggaactgcctaagaaccccgcaaagtactttcagccacagggcggggtcattcgcgtcgtaggtgcgtcgtgaggtcgtggcacgtttgcgggcgtcagcggtcagccagtgcaagtgccgaggccacaccaacatggcgccggcatgggtcatcacctgaaatggtcaaagagcgcgtgctgggctccaagcagccgcggccttcaagccatgctgctgttgggccaatgctgacacgcctgcgccttgcttgccttgctgtcgcaggcgacatgaacgctccgccggaggtggcggggacatcggcgggcgacgacaaagcgtttgtgttcgggtcaacgatccgggcagacggcgcgggcgcgcggccggtggacgtgtcggtgtcggcggtggaggcgacgtcgggcgagggcgcggcgccgggtgcggcgcccgtgccggtgcaggcggcctgggcggtggacgacgcaaagcccaaagtcaaccgcccaccagcatggggcttggcgcagcagatgggtgagtgggtgcacgggctaaaccgtggctgctggggttgcgggccgtggggtgcgcgcggctgcggacccatggcagcacgttcggcgctaggttaagctggcgaaaggggaggggccctaggacagaaggagggagccgccggggacaacggcagcgcggcagcggcctcgtcgctgccaaggatgggagcgggcgcttgggtggtggtctgaccggaccggcctgctgttgctggcctgggctggcatgtgtcctagacgatgcgtgtggactgacggcgatgccgcacaatgccacggcgcctcattccggcctgcgttgctcggcggcatgtctcggtcggtcattgccggcccccctagtcccgaatcgacctccctagacccgacccggccctcctcccgcctcctgctgagagctgagctgtgcctcctgcccacccacctccccctgcagaggagctggcggtggatgacggggaggacgaggacgagggcaagaacccctacctgggtgtgggcggcgacgacgacgaggacgatgacggagagggcgatgacgacgacgactacgacgacaacggggagtacggcgacgagccgggcgagggcgagccgggctggtccgccgaccccacgcgcatcgcgcacatgaagagcgccatgatgatccagcgcgcggcgtgcctggacctggtgggcgagaaggccttcaacgagctgtgagtggaggggcggcagggggaggggagcgcggggctggggctggggcaggggaaaggggaggcgccggggcaggggcaggggctggggctggggaggggagcgcggggccagggcaagatgaaggcagcggttttgcattgccaaatcgggtttgcgtgtgcattgtgccatggtactgccatgtgcgcacggcgatcctttgggagggagcacgggccgcaggtggtccctcctacctggccgcctccgctggcccagccccatgtctggatcggacgcgaacgtcacccgccggcgcctgaccgcctcttccatcctggctgccatcctggctgcaggtatgcgctgctgaagagcaaccaggtggatgaggcgtccatgacggacctgtcgcgcctggtgttcaagatcatcccgtacgacaagtccgaggtcatccagatgatgtacaagctgctgtacctggagtcgcagctggaggggcagtga

SEQ ID NO: 61 - DNA, 2813 bp, Chlamydomonas reinhardtii
atgctgctcgcggcgcaatcaatgccaaagtgcatatgggataacgttaccggcgcgttcggccagtgtgtcgcgaacgactacacgctgctgtccatgagcggaaaaccaccgactgaatccgccaggttggtgccgcgcggtcacacacaggctcaggctcccgcgctagactgcgccaggcccttgaatccactgcgtcatctacagctgctgggcccttacagcgccaacggaagctgttcccgcttctttgtctcccgatttcggttgcacgcacacgcggcacacacttttacacaggctgttggcgtacgcccagcaccgcgcagtgctgtgcaagcggctcacgagcgaggcggcgtgcctcctagccatggacctggggtgaggcgccgctgctaaaagggaggggatgggcagaacccctgtcttcattccgtgcgccacggcgctgccggttcctaggcaccagctgtagcagtacctagccggcgttcctgctacaccaccaaggctccgtgcttgcgttccttcacacatgtgtgttatcagcacgcctctgccctgtggctcacaccacaagcctacctttaccacgcgttcggttcacaccccatggctcatgactgcaggtgtggctgggaccggctggccggcctatgcttcgcctcggacgcggcgctgctcagacccgaggtatgttgttgtgtgtgattacaaggtggtgcattcctgtccttgtagacaccgcgacgttattggttgcgcgcacgtgtcatggcagtagggggcagctgggtggaagcatgacgaagagttaagagggtgcgaatgctttgcaccttcggggtcagctgctggttgaaccgttgaaggggacagatggcagagtggagggcggagggcagaggctgcgccacaattgtctgaagctgtgatctgggcggaatcggagcacaacgaaaaccgggacggttctcggcctgactcactgaaaggccgccgtttcacgtgctgtggcttggtcacgtgcccgtggctcttcaggtgctgcaagggcggctcttctgcggcggctccctactcgaccaggcgacccgctgcctgctactgccggggcccagcaacggcagcagtggcagtagcagcggtggcgggggcggcagtagcggcaccggctcggtcgcggcaaccagctgtagcgccgctcacaccgcttgcacctacctcagcccaacgcagctggcggcggcgttggcggcaccggcggcggcgacggcggctccatacctgcggctggcggcgctcgccaatttcaacgactggccgcctccaggtgtgggggcgggctcaagagggattggggtttcaaaagcttgggatcacgacggcttgggatggggcgccatgtgagctggaggaggagcaccaggcgcagcagaggcgcgtatagataggggttatcaggggtgtttgctggcgatgcgtgttggtgtgtgtgtctggaccagtaggagatgaggggatgacccgtccgtgtccctaagggcgccggctccagatctccaatgctcaaaggcagcggcatgcagtataccgccacgcatgtcccacgctgaccaaccgcctgctgcttgctcacgacgtcgcccccgctttgtgccatcgtctgtttgatgcgatgtgcatgcagagggcagtggcgcatgtgtggccaaatggttgacgcaacccgacacactggcagctctggcgcgcagcgtctccgccaacccaacggtgtgtgtgtgggggggtggttttcgaggccccttgctgttatggtcatggcagctgtatgacattcctaccgtgcccctgacgcaccacaatacacagtgatctgtacactccatatgatccgtacattccatgcggggtgctgcaggtctggttgctgcagccagacctggtgggctcgggctgtagcagcacgctggcaggagcaaacatcagcgcagcacccgagatggcgcgggtgacggcggcagtagcagcggcggcgtccgcgtgtcaggcagcgggcgtcgccggcggcgcggacggctgctcggcggcggaggatggctgcgactgggctgatagcggaggggcaaccggcggcagcagcacaagtagcggtgatagcagtagcggcggcgggacgtgcagcgtgggcacggcggcgcttctggatgcgttgtttgatccacaagacgtgagtggctggcagccacagacacatgtttgtgctttctgacacaatgatgacgccatccggcacggaatggcattgcacctgctcgtgctgcgctcacgtgcggttattgctgagacctgcccctgacctcgcccccgtcccaaccattgtcaacactcctgcccttacttcctcaagtgcttgccaacagccaccgcctgcgccccagaatgaacgacccatccacccgcccacccgctaattttgcttggtttggtttattgtgggctggtatctacaacccacccacccgcccaaacccgtacaggcctgggtgagggcgcttgatggcacgaccgccctctgctccgcccagggcactaccgccagctgcgccgccgccggatccattatcgtggatccagcccggctcgacacgtggcgggacgtgctggtagacggcggcggagattgggtggacggtggcagcggcggcgcaggcggcctggcggcggggcaggcgctgccgctgctgcgctggatgctggtcgtgtgggtggtggtgtttgccggcatggccgccgtgtattaa

SEQ ID NO: 62 - DNA, 1849 bp, Chlamydomonas reinhardtii
atggtcgctggagggttgcagcccccaagcattgacgaggaggaggctgcggcgcgcgctgtgggccagggcgttatttttatcctcgatgatgctcagttagaggttgcgcaagtcggcaaggtgcgtaaacaagtcggtgaccgaaacgtcggcggctgagtcccgacaggctttcgcccacgcagacctaccagctgctgaactgtgatgaccacgcgacatatcttcgaaagcacaaaaaggacccggcgctgtaccgcccagacatttgccaccaggtgcgagccccggcggggtgttgacggggggcgtgccgtcgtagcacgtcggcaaggcgcctggcgctctcgagcggcgttattctaccgcagccatagcggttgcatgccaagctattgaaaggcaatgccgaatgtgtacacgacacgttgggtggcaccgtggcgggatgtggcactggctggggttctggcccgcggcactcagctgctgccgcatcggtccttgcgcaggcgcttctaaacgtgctcgacagcccgctcaacaaggccgggaaaatcaaggtgggatcgtgcggacgtggggagtgcggtgtcgactaaagctgctgtggagttggctggggcaacggctgcccaaggcccagctacgttatgttggcggtcggggacaccagctacagcggtgttgcgacagctggcacgttgcggttgaggcaggaggcgacgccacagcggttgcagtcgctcagggcggggaggcttggcccggggcggtcaggacgcggatggcggggagacagtggtgcaggagacaggacgcgggaggggatgatatgggaggcagtgatacggtaggagcacgcgtctgtggtcccctgccgagccacacggccatgcggccgcagctgcaccaacacatcctccccccggcacacccgcccgcacctgcacctgcgactgccaccgcaggctgtgtacgtgcgcacgcacaagaacgtgctgttctccatcaaccccaagacgcgcatcccgcgcaccatcaagcgcttctccggcctcatggtgcagctgctgcagaagctgtccatccgcgccaccaacggccctgacaagctgatgaaggtgcggagtggaggagggaggggggcagggggttccaagagggggcgtgagcggcggaagtggcgggaggcagggacgagggggcacagggtgggagcatgccgaaccaaaagcgccttgtatccccatctctagggtgttgtcagctgggcatacactgcaaagtgatattgatcccaacctacgtcactgcaggtgattaaaggcccggtgactaagcaccttccgctcaactgcaagcgcgtgggcttttcattcgccgcagataagcacgtggccatccatgtgagtcgtgtctacggctgtacggctgtggtcggggcctgtacgggacagttggaccaggatggctgggcgggttgcagaggtgtatggcttggtgtgcggccgcggcgcgggcgcagtgcctggtgctgcctgtgctctcctctgcatacccgcacacgcttcatttccaacccgacgcacgcaacacattcatccttatcacatcctcccgtatccacttccgcgcctcctcctcgtgttcacccttgcaggagtacgtggcggggctggaggacagcgggcccattgtgttcgtggtgggcgccttcgcgcacggcaagatcgaggcgccctgggtggatgaggagctaaacatcagcgagtacccgctgtcggcggcctactgcctggcgcgcatcacgcaggcgttcgagatgaagtggaagatcgtgtaa

SEQ ID NO: 63 - DNA, 3311 bp, Chlamydomonas reinhardtii
atggcggaccctggggcccaacctgtcccagctccccagtctgcggaagagccggtcaccggaggccttcaagagtccgtggaagtcacagcgtcagggaaattagactcatacaaccgcgagtacaaccaattcctggtgcgcccggagcctgggccccggtctgcagtcgggaaactttgtagcacgatggtcccgttcccgacccgttcccaccagttctacgctgcggcttgcaggtttgcggcagcctctttgagtgccccgctaagtacctgcccatcaagcccatcggcaagggggcgtatggcgtcgtctggtgagccagctgggggttggacggtcggcgggggcgtgtccttgctgctgcggctgctaccctcctggacccgttgttcttccgcaccaaaccttcatctcacgcacggacctgccaccccctgcattccataccgtccctacctccactacatccaaacacatcccactaccgacaactcccacacagctccgccaagaacctggacaaccaggagaaggtggccatcaagaagatcgcaaacgcctttgacaacgtcatcgacgccaaacgcaccctgcgcgagatcaagttgttgcgccacctgcagcacgagaacattgtgcagatcaaagacatcatcccgcccaccaaccgcgatgccttcaaggacctctacgtggtgtatgagctgatggacaccgacctgcaccagatcatccgctcgccacaggcgctgtccaacgaccacagccagtacttcctgtaccaggtgcggacgcggtggcggtgtatggcggcgcggtggtagtggtgtttgcgatggtgcggacgtggtgggtgtggcagtgcgcggttgaggaagcggagctgggggcatcgcgtgggttaggggcgggaaaagagttgggtgagggagtggtggggtctagccgaggtggttctcataggccgtggtcaatgcattgtgcatcggaaccctcttctgagctcaggttccaagcttactcaccgcgctgcctcgtttgcctgccctgatctccgcctaacccatgcctcctgttctcccaccccacagctgttgagagggctcaaatacatccacagcgccaacatcctgcacagagatttgaagcccagcaacctgctcgtgaacgccaactgcgacctcaaaatctgcgacttcggccttgcacggaccaggtgcgtgcctgcagcatgccttcgcgcctgaatgccggcctgtcccacaaagatcatgggatacacggcactggcacccaacagctccgtacgccccctctgtgtccaacccattccactccacgtcacccaagcatgcatcccatcaagcacccgtccaccgaccccgcgcaccgcacgcccccaaacgcccccccgcagcaccagcaacgagaaggagttcatgacggagtacgtggtgacgcgctggtaccgcgcccccgagctgctgctgagctgcagcggctacaccactgccatcgacgtgtggtgagcaggaggggggccggggcgctgcgcgtggactgagtgagagcatcgggccagacggggctgcgcggctccttcgcctgcaacctcaacacagtacaaacgcgtctcccgtgcgctctcttagactcttacacacgcgacacacacgcaacacgcacacaggtccgtgggctgcatcttcgcggagctgctgggccgcaagccgctgttccccggcaaggactacgtgcaccagctgtccctcatcaccaaggtggggacacggcaaggggggggggacccgtccatgcaacacgggggtggggtgttgaggcgtggggccgccttgccgactgccatgtgtgtagcaccgtgcgcatatgcatgtgcctgcgcagcagggcgtgcgcagcaagacgtgcggggctgtcactgcgtggcacaggccgcgcgcacacacctgccccgctcaccactgcccgcggtgggcacagcgcaccggcgcctactcacctgagaagcagtaggacagttgcgagccccatctccgccagattgcggacacccatctccagctacttgtaacccccccgagtatctcttcacgcacaggtgatcggctcccccagcgaggaggagcttggcttcatcaccagcgagaaggccaagcgctacatccgctcgctgccgcgatccgagcgagtggacttcgggcagctgtggccgcacgtcaccaagacggtaagagggcggagggcggaaggaaaggtgggaaaagtggggggctaactttgaaccaatcctgtaaggaaacagtcgcgctgcaaggagaaacaaggtggggggcgaggcgggttgcacgaacgctgctggccaacaggcgagacccagcaacggcccgggcgctgatgcagcggctggcgccttgcgggcttgggcgcggccctcggtactccggtacttgcatccaacccgcacgcacccacggctcaacaatacaacgaatcgcaggcgctggacctgattgacaagatgctggtgttcgaccccaccaagcgcatcaccgtggagcaggcgctggagcacccctacctggcctcgctgcacgacgtgtccgacgagcccgtgtgccccacacccttcaccttcgacttcgacagcgagcacctcacgccggtgcgccggtcacgggcgggcgcgagggctgcgggcggagcctggggagacaggagagcgcggagggctgtatttaaaacggaactgaagcccgtccagacggaggactgagtgtgtgtgtgtgtgtgtgtggtgtggacaatgtagcgacctggtgtcagtggtgtgacgagtgcggacacgccggactgaccccggttgcccttgtcatgtcttccctgttgcgccgcaggacgtggtgcgggaggtcatactgcaggtgaggggcgcagaggcgcacggccgtgtcaaattgtttgtttgccgtatcatattggttgtttgccgtgtgtgtgcgcgcgtgtgtgtgtgtgtgtgtgtgtgtgtgtgtgtgtgtgtgtgtgtgtgtgtgtgtgtgtgtgcgtgtgtttgttgcgtgcgcatgcatgctcatgcgcaaacgcgcatgcgacagacggtggctgtggtaacgcccaggcgctgctacggcagcactcgctgagatactttctaccaccgtcagtcctattgtttcgtgctcgtgcgctcactctctgtacacgctgattttcgcgacacgtacttgtgcaaaccgcaggacatggccgagctgcacacctga

SEQ ID NO: 64 - DNA, 4354 bp, Chlamydomonas reinhardtii
atgctgcagagcctgctgatcgtgctgctggggtgggcgcgcgaggagcacgtgcccctgcgggcgggtgcgctggcggctgcagaggctgcgctggcgctgccggacatgggcatgcccagcatacccggccgggccatctttgctttcctcaaggcagtggaggtgccggtgctggtgctgtgcggtgggtatgcgtggcgcggcgtcgtacatgcatacggagatctatggctggggcattcaacatttgtcctggtgcatttcgtttgcgcgggtccagtcttggtgcgttttgtttggccaattgtgctgattttgttgcagtagcgcggggcaggagtaaagccgtgcacataatacataacaaagacacggcatagagtccctgtctgtgtatgtggcagggaatgggtttggcccgttttggtcaagtaaggcacgatccaaacgaaccacctccccagaccggcgtcatacagcatacccttacttgtgggtttggggggcactatccaagtgggttctgctgctagctctttgactccgacagcttgcttgcatcaccaactgctgtagtcccgactgcggacgtgctactccgctccctagctcctgatgctgctgacgtcagcctccccgcccatctattcatccctgctgccacacgcacacgcgcacgcacacgtacgcagacgagatgcagcggctgttcctgccgctcatcggcggcgccgagccggacgctgccggggccgcgtacatgcgcgacgtgttcatgaagcagctgctgttggacggcccccacaccatgctgtggtgcctcacgggatcatccatggcgcacacctgcatcagcatcgcgcgcatgccccccaacggctacccgctcatcaccatggcctgcgccatccacctgccagcgacctacagcgccgcgcacgtaagcttcgcgtggcagcagctgcagcagaacagcggtcctgatgtggagctggaccgccagctgctggagctctgcccgcagtcaatcccgctcctgacgttcttggtgcacacatggttgtacaaccgcggccgcagcgacgtgcacaccttcgtgcgcgacttcatgcggttcaagctcatggagcaggtgtgtatgtattgcatgaatggaagcacagcggcacatgttgttgttgttgttgagcgggcgtttggtcgcaaaggcgtttatttgctgcaccaaaccctcaggcgtcctggatgctggatgctggccctcttactcatacattgcccgacatccacacatccacccatccgtttctcttcggattgtctacctcaggcacgcagggagtggacgcctggcctggaggccgtgccggcgtcgcagcggctcacgatcctggacctgtcgtttccggccgtgggggcgcgcatcgacacagggctgcaccccggcttgaagtactacctgacgccgcacctggagaagagggcggacggccactacttccttcgcgactcgcaccagcgtcagatcgtgcgggtgaggcagcagcagggcgtgtgattgtcgccgtacgtgcgtgtgtgcgtgcgtgcccaagtaagccaagcttgtctcctcatcagcacttctcacgcaccacacctcgctcacgcaaccgtctacccatcatcaagcgcttgcatgcaaacgctcagcgctggggccacctcaatgattatgactgcaggcttacttgcatcctcctgcgtgcccccctgagtttattcctctgcttgagtgccccccgggcgtccccttttgaaggtgcgcgccacgccacgccacgccctcgcccgccccccacctgcgcttgctcacgtgcagttcctgatcaacgaagaaggcgcgctgcggagcggattgggcgagctggcgttcagcgcgaccctgacgcagctggatggagggtggaacctgtttcacctgggggaggccgcggactacctgctcggtcccggcgcatgccgcaggtggcagaacggggagccgccggctgagacggacgcgttcgaggacaagttacaggttagatagcagatgctagcgtacttagatgggctacagggcttgagctcagaagttagtagggtttgggggggagatagaaagcgctggtaagcgcagatgaaatctgcatgggctgaaggaactggtgacgctctttcgccgccgtgcattggggcgccccgtgttgcgtgccgctcgattgtgatgtgtgtataaaattcagtttgcctgatgcgatgtctaactatctaggttgacattactcatgctactcatcgcaggccattgccgacgacgtcgccgtgaagctgtgcgcggcaggagcggcggcggcaggaggcgatcagcagccgcagcagcaacagcagcagcagcagcagcagcagcagcagcaccaggagcaaacgcagcagcagcagcagcagcagccgggcagcggcggcggcggcgcggcgctgggcccccagccgggcccccagccgcaggagctgtgggagcggcagtcctggttccaggaggcgctgaactcggagtggaacagccgtgatcgcgaggcgtacatggaggaggaggacaacaagcaggcgcggcgcacgcacctggccatgctggtcttctacctgcggtgcgtggttgtgggtgggtgggtgggtgggtgggttaaaaggcgagtgggtgggggatgcaactgaagctcagttcctggatgggtgggttgcagtgggtccccttgctgctgtcgtccaggagatggggcgcatttgggaggatgagcacatgcgcgtaacgtgccgggacggacgcggaggcatgtgcttcatttgcaggcagcggcggggccacgccgtgacgggcgctgctatgggttcgtgctgtgggtgtgcatgcgctggcaaggctgtgcgtctcatgtctctgcgtcccatgtctcgctcccctgacctaccatcagtggtgtaccgaagcctgagcctgaggcaccgagcctgaggctgaggcgcgttggtgtatgcctagacgtctgacctggacactgctgacccgggcgcactgccacgactgctgccgtatgtacgtgcgtccgcacgcctgcaggctgagtcgcaacgtgcttggccgtacgaagccttgggatcgggagactggctccaagctgctggatgtgggggtggttgaggcgctgcccggcgtgctgggccagtccctctttgccttcaacgaggcaatggtgggggcgctgcggctgctgccgcgccccaccgtgcaagccgccgctgcggcgtttgcggcggagctgtcaggcggcgtttgcggcggcagcgttgatgagggctcgggcgaggacgacagcagcagcggcggtggcctgagcagcggcagcggcggcgccggcagcaccagcggcggcggagggcgggggcgcggcgcaggggcgatgcctatccaatgcgcgccttcgcgcccggcgggaccagcggcggcggcaggatgtggtcagcgcccgccgctggtgtacgccaccggcggcagtcgcggggggtggggcaagagaaaaccgcgggcacctacactcgtgccgcgcctgcgtgcacggcttccgctctttgcaccaccagccgcagcagcagccgcagcagcgatggggccacggctacctcgctggtgattcgggcgccagtgtgtgtcggccgctgccgctgctgacataaccgaccgtgaccggctgtgcgccgcggtcagtggctaactgcgcggcccagtggcccagtggcccagtggcccagtcaaggctagggagtggtagtcagcttctggatggctccgagtgcatcggtggcgtgacgtgcgcggcgtgcgtgcctcagtgaaagcacgtgcggcagctgccgcacgcccacgcgtcgtgcgtgtgcaggcgggccgacctgctgcgtaggatgcatcgattggtgtgcggtacgtaatgggttgtggtaggcgtgtgccatgctgcgaacgttctgcagcctctctgtcaatatcaaatggatacatcgacatcgatacaaggtctttccttcacctccggttctgggcgccgcccaaccgccgcgaagctacctcaatgcactcgcacagcccccctgccagtgcgcccccgcgcagtgctctcacccataccatacctggctgagaacgcttgtcctcaactgccttctctttttgggtgtgcgcttccacaaagtaaaagactctcgggtcgtcctgctcatcaggacggccatccgcggccccccctcaaggcccaccacacgccacgtgtgttag

SEQ ID NO: 65 - DNA, 1519 bp, Chlamydomonas reinhardtii
atgctgcttttaggactcgttctggccctcgctggccatgtagcggctgcgccttcaagcgccatgatgggcactggccacaccgtgggctttggcgagctcaaggtgggagggaggcagagcactgttgcacgagcctctgtgctcgcgcggcatccattttagcggcgaacgcacactaaatgaatgtaggaagaatggcgtggtgaggttgtccacctgtcgtggtcgccgcgagccttcctgctgaagaatttcctttcggatgaggagtgcgactacatcgtcgagaaggtgcggccagcgcagcgcaagtgcggtgtcaagggctctattgctcttagaattatttgtcacacagcctgcagtgtttcctcgtgaaagcgaaactagtctcgcggaattcagcgggcgtgtgactgcatccccggtcgcccacggattcacaggctcgcccgaagatggtcaagtcttctgtggttgataacgagtcgggcaagagtgtggacagcgagatccgcaccagcaccggcacctggtttgctaagggcgaggactctgtcatctccaaaatagagaagcgcgtggcgcaggtgacgatgattcccctggagaaccatgaggggctgcaggttctgcactaccatgacggtcagaagtatgagccacactatgactacttccacgaccccgtcaacgccggccccgagcacggcggccagcgcgtggtcacgatgctcatgtacctgtgagtacgaggattaacagaggcgcatgcgagagggcaggggccgccgatctggagggctgggaactttgggtgcgagacccatggttcaatgacgttctgcaaggcggagctgggcgccgaggtgtgcgcggcacgacccgtgcgcacacctcaacccagccttttatgcatgcatcaccagcaactcgcacgggcgctctcccttcacttacgcaggaccacggtggaggagggcggcgagacggtgctgcccaacgcggagcagaaggtgaccggcgacggctggtcggagtgcgccaagcgcggactggccgtgaagcccatcaagggcgatgcgctcatgttctactcgctgaagccggacggcagcaatgaccccgccagcctgcacggcagctgccccacgcttaagggtgacaagtggagcgccaccaagtggatccacgtggcccccatcgggtgagcgcgtgcccatacatggggttgggtgggggtggggccagcaagcgccgatgccgatataatcgaggctcagaacctgggttcggttgcaggttgggtttagttcgcctagcgatggggctgggtacctagtaggtcatgtgcactgtgggccgggccgtacgccataacgtagcgcgggcccaagctgggcagtcggcatcaagctcgcatcaggcagcggactctgttgctactgtccctgtccggcctcgccattactgcacgccttgcctcggtgtactgccgtgcagagggcgtcattga

SEQ ID NO: 66 - DNA, 3214 bp, Chlamydomonas reinhardtii
atgggcgcgaaccagagcactgaggaggtgctggacgccgtgaaccaggcggacgtcgataagcttgcgccgacgcctggccctagcaaggtgagttctgggctggcgtagttgcaacttgcttgagactgcttgccgtttgccagtagggcataaacgattgcctgtggggccttcacccagcctttcccgtgctgacgcccgctggtcttcgttcgcaggagggaggcgccaccaagctctacaagtacatcgtcacacccagcggcgagggcaactgggagctggcgagcgcaaacgccaagccacgtttctatgacgcgctggaagactcgaacgccagcggcaagaaggatttcttcctggagattgagcagggcgacgtcgacgtgcacgtagatgcggagctcaactacgttcttgacgtgaagcagcgccgcatcacctttcacgccaacggcaccatctacgcgctgcgcttcccgcacgacacggcctgccgcgccttcggcgagcagctcaacgacgcgctgttctacaaccagtacggagtggagaacgacgacgacagccgcgccaagctgtttgaggacaacgccggcacactgttcagcaagaacacggatcgcatgtttgagcccatggagacggacgacgcgggcgacgaggcgggcgcggaggcggccacgccggagacgatgacggagcgtcgcgccaaagacacggagaaggatgaggacgccatcaacggcatcatcatgggcgcaggtgcgtgcgtggggggtgccttaggcggatgcatgtggcaggtggagcaggtgtggttgggcccctcataaaggccttcggatgcggggtacggatgcacgacggcgatgtggtggctctgacaagagttctcatgggttggttgggggttcttcgtaagcccggaacgattgcgtggttgggcctgggtgggggagaacgacgatgatgatgtggtggatgctgttggctctgctgaggccagttaccatatacttacgtctatcctgccatccttgcgcccctgtcctacctacaggcgagaacaatttcctcatgcggggccgccgctttgacgtgcttcgcaacctggagggcggcggcgtggaggacaagggcgtcagcttcagcctcacgcctctggccggcggcgccgccacgccctcgctcagcacgcgcaagacccgcggcacggcggcggcggcagaggccgacgcgctcggggcgggcttcacgccctccaaggtgcgtgcagggccaggggtgcgtgcagatgatgttgttgggccgtgattgctttggtgctgtcttgacccggctctctgtcggtatctccttgccacgccacgtgttcttagcttagtcctgagccctttcctgcccttcctctccctcccaacccccctgtccccgccactaaccccgcccgcccctggctgcaggtgctcctgacgcacggcgagcggcgcatgaacctgctgacgcccgacaaccggcatgtgctccaccacgccgacattgaggcgggcaagatcgtgagcacctttgctttccagaaggacaccgtggacatccccattgtggagatcgcgtcggactacaaggccgcgcagatggaggagcactcgcagttcctgggactggaccagaaccgcctgtgcaggtgggcgctcagggctgggtggactgggagggtttggaggcttgggggaaggtttgagttgcgggttggggaggagaggttggcaaggggattgtatgcccgagcccacacgactaagtccaatcacttgtcagatggggagaggtgtggatggaggcggcgtgtagaagaatgggttctggtagtggagggtgtgcccgcgcagtaagcgcgagtgaagtgggtctggtaggttcgcttcaacactttgcatggccccataccgcccttgctgacatccagatccccttccccctgctcttgcgcgcctgcaggtgggacatccgcgaccggcgcggtgtggtgcaggagatgcccactgcgctggactacgtgggcggcaaagactacagccgcggcaccaacttcacgtgcatggccaccagcggcgacggcttcgtggcggtgggcgccaaggacggccgcatccgcctctacaacagcaagacgctcacgcaggcacgtaccgtatgcgagagagtatggctgggagtggtgcgttccgactccaaatcaacccggacacccagacaaagtacgggaacgcgcccagccacgaaaacaattgcaagcttccatactgtgttcccagtcatcagcgccccacacaatgtaccggtacccgcgtccaagtgcgccaccccatgcagtgccttcgccttacctccctgccccctccccctccggtctcatcctccgcaggccaagacctccattcccggcctgggcgcgcccatcaccgccgtggacgtcacgtacgacggcaagtgggtgctggccaccaccgaccactacctgatgctggtcaagaccacctacgtggacgacaagggccgcaactccaacggcttcgagagccgcatgggcggccgcggcgcggtgccgcggctgctgcggctcaagcccgaggacggcctccgcacgaaggtgagcggccggccggggtagaccgggagcatgggggagatgggcagcaacgggctggggagggaggtactgcacatacagggcgtgggagggcgaaaccgcgaatgcgacagggggacacagccgagggcgtgatgcaagcgcattccagcacctccttacgcagccgccgactccgtacgttgctgcacacctgttcttattcctgcctgacccagccttccctctttctcgcaccctgctgctccctgcctgccgccacagggcgccaagttcagcaagggcaagttcacctggatcacggagggcggccagtcggagcgctgggtggtggccagctgcggccgcttcagcgtcacttggaacttcgccaagatccggacctccaccaccgagtccattggctacggcggcctgcccaccagcatggactacgtgctgcgctccaaagaggaggaggtggtggacgtggcgttcgtgcaccagaagtacatgcgcgacgtggagcaggcggccatggtggtggccacgccgcacagcctgttcaatctggcgtaa

SEQ ID NO: 67 - DNA, 2524 bp, Chlamydomonas reinhardtii
atgagcatcatttacgcactcacgctggccctcaacggcgcgggtgagtcgttcgacctttttgggaagttagactcgaaaccgtcgagcttgtcgggggaccgcaggcgtcgctagttgcgcaccgggtggccatacaagcaacacgtgatagtagttaagagcaaaaaaggttgcagggcgggctgccgcactggtatcgacacagtattgtagaaccgccccgcacgcgccctccccccccccccacccccacccccccacacacccctccaccacgtgccttactcgccttccctccccgtcaggccccaagacgtccacgcactcggagctgctggcagccattgccggcggcgccgagaacgccgccaacttgggtgagggcgacctgaactcggagctgggccgcaccatgacgctgctgaacggagccggcgccggcgcggccgagggctccgcctcccgcatggtgctcgccaacagcgtgtggacgcaccgcggcaccacgctgcgtaaggagtacgtggacgccatgcagtcgctgttcgacgccactgcgcgcgaggcggtgaacggcgccaaggacgtgaacgcctgggtggagggcgtgaccaagggcatgatcaaggacctggtacaaaccgaccagtgagtacggcaccgtacggcagtgcgggcattggagggtggtgtgggcacgggcgtgctgaatgcggggcggggttccaggcatgactcgcatgaggaaggggggaggctcgtgccgatattgtgctgtgcgcaaatctgcaccccgacacggctgctatcaactgctgctgccacatctgccacccaatctgccaaaacaccgtgccaacacgccttctgctccaatacctctgacatctgccaaccaacctgctacgcaggtgggacgccatcctggccaacgccatttacttcaaggggttctggacgcacgccttcaagaaggagtgagttgggggagcatgaggctgttgcagcaggggctcttgtccaggtccatcaccggcaggcgtgcttgttcggtacccgctactcatcggtgcggctggcgggtcggaatgcacaaagtctccgcttattgacaacacgccctgtaggcctgtactgcagtgaagaagcccagcccgcgtcccaaaccgtgcctcaactgcccctcgaaccccgctcccccacccccaaccccagggacacctttcctggcgagttcaccacgggcgccaaggccaccaaggaggttcccttcatgtgcaagaacttcgaggcgcaggaccgcattaccgccgtgcgcaaggtgggcagtcgtgacagggcgtttgcgggagaaaaagtttgcgtgtcaaggggcctgggcgcggcccacagaacgctgcagccactgctgaggggatgacgaactaccctggcttgctatggacttctgttgcactattccggcatgtaaatctgctgacctgtccgccggcctgcctcgcaggagggtctgtacgacgcagtggcgctgccgtacaagggcgacgccttcagcgccatcgcgctgctgccggcggtgggcgtggccatggaggcggcgctcaaggactggggctcggggccgcaggtgggtgtggcgggaccgtgcagggtgggcgagtgagcaagggggcgggttgggaggggtgggatggaatgggctgaggggtaccaatttggtttgaagcggtatctgttgagaggacagaacctgagctacagcgccgggcagcgaggggtcatttacgcacgtggcatttgttaaagagcacaagggaaggaaacgcgcaggaccatgcatgcatgcaagacagtgtgtggaaatcctaggtgtgtgcatacgttgttgccgtgtgcaggagctgcgcccggtgggcaagtgctttgtcaagctgcccaagttcaaggtagagagccagctcagccttaagaccgtgctgcacaagctcggcgtcaagcaggcattcggaggtagcgccgacttcagccgcctcagcgacaccaagatgtttgtcagcgacgtcgttcacaaggtaagggcgcgcatggatgcatcgatggtacggtatgcatggtgccaggatggcgatagagtgtgtgcgggcggggggcagccgatgcagcatggggccctgggcgagcccatggtccttcagccctctctctggtcaccagattgaagggtagcctgcctgcatcttccctggcgctcctctcctggcacggactcgtcaaccaccgaacgaacgtcccctgtgccaaacgaacgttgcctttgcctgttgctgctgcgcaggccgtggtggaggtggacgaggagggcacggtggcggccgccgccaccgccgtcatgatgctgcgctgtgcgctgccgatgcccacgcccgagttcattttcaaccgccccttcgccttcatcatcatgcacacccccaccggcctgcccgcgttcgtgggcaccgtgaacgaccccagccagtga

SEQ ID NO: 68 - DNA, 3074 bp, Chlamydomonas reinhardtii
atgaggctcctagttgcctgtgctctattggcactactgcagctcagcgctgcagtgcgcctgcccgcggcgatagagcaggctgtggggaggcagctcctgagcgagaaggaccatagctaccagcctgatgacaaggtgccgctgtgggctagcaaggttggacccttcaccaaccccaggtaaggctccgggcgctccagcgcgacttgcgcgtccaaccggcacaacagccagcgacaacaatttgccctctgcgccgcgcagcgagacatacgagtattacagccttccttactgccagcctaaggatggcgtgaagcacaagctgctgggcatgggcgaggtggtcgacgcaaaccgcatggccagcaccccctaccagctgcagttccgcaagaaccgccagcgcgaggcggtctgcgagcagcttctggatcaggagaagcttgcaaaattccgcaaggtgcgggggtttgcactgcgggggcctgcgggcgcttaaaacgaccacccgtcacatttgtgcatctgcgcgcgcaggcggtcgaggaggactggtactttcaaatgtactatgacgacctgcctgtgtggggtttcatcggcaagatggagaagctgttcaagccgggcggtgttaccgagtacaagtattacctcttcactcacatcgactttgacatcaagtacaacgacgacagcgtgattgagattaatgtctccacagacccccaggaggccgtggatatctcggaggagattacggacatcgtgaaggcgaagttcacgtactcggtgaagtggacccccacgctaaccaagtttgagcaccgcctggatcgctacgagcgctttcccctcaaccccgtgcacctggaggtgcgtagggctattcagaacctgcgctctggtggtgaagtgcgtctcgacttcaggctcatgtagcagtgcaggcacggcacacatacacataatcatatgcaccctatcccggcttcaactcgcagattcactggttctccatcatcaactcgtgcgttaccgtgctgctgctgacgggtttcctggcgactatcctgatgcgcgtgctgaaggcggacttcattaagtacaacaaggacgatcgtgagtcagggccacctgagaaaccgcaggctgtgcttgggcgagacaaccgaggctggctactaaagatcgatggacatgcagccgatggacatgccgttgggacagctgttgcatggcggcacaaatggcaatgcacgtgtcggggataggcaatgagcacacattccggggacaggtctccttgcttacagtgtgcaaccggccctgcaactgcagcggccatggaagaggaggagtcgggctggaagtacgtgcacggcgacgtgttccgcttccctccctacaagaacctgttctgtgcctttgttggcacgggcacccaggtgcggagcctaacgcagggtggcgggactggaggcgcttggtcgtccagcacagacggttgccatcatgatggggaaagcgcacatggggcgggcggccacgcagcaaacctcaagttgtttcgcaaggctgagccgtgcgagcatgactcctgcaaacagcggaacggtagaagggtgcctggaaatcgaaggaggaggggttctgggaccggtgtgatcgggcgcacctcacgtatttcagggaaagggctgtctcaaggacggttcacgggctgacatgcttcgggaacaacggatgggcttggcggcgcacgtgttgccgaatgctacatcactgacaaccggtcgcgtggacgctttgctgccccgcagctcttctatctggcgctgtttgtgttcgtgctggcgctggtgggcgtgttctacccgtacaaccgcggcgctctgtactcggccctcattgcgctttacgcgctcacggccggtattgccggcttcgtggcgtcgtcctactacaagcaaatggagggcgagctgtgggttcgcaacatcctgctcacttgcttcgtgtactgcggccccttcctgctcatgttctccttcctgaacaccgtggccatcgtgtaccgggtgagtggagcaaaagctgctggtgctggagcgccacgctactggattgcgggctaagggatagcatctctgcatgggctagtaacatcgacatcgggcggggcatgtttgctgcacttcatgtgagactgtgtcagaccatctgtactactcgcacgtttgcactcttgcacctacagtccaccgcggcgctgcctttcggcaccatcgtcatcatgatcctcatctggactctggtgaccatcccgctgaccgtgttcggtggcattgccggcaagaacaaccggtcagcatgggcgccctactcaaagggtctatgtttgggagatgacggcaccggacagggcgccgcagggatgtcatgaccggttgcgcatgttgctgtagcggggggttgggaatggtctttgctgctggctgacgccgtgtggctgacgattactccttcccgctgcctctcctgtctgtgccgcccgcagcgctgagttcttcgcgccctgccgcaccaacaagtacccccgcgagatcccgcagctgccctggtaccgcaccacggtgccgcagatggtcatggccggcttcctgcccttctccgccatctacgtggagctctactacatcttcgccagcgtgtggggccacaaggtgtacatcatctggtccatcctggccattgtgtacatcatcctcatcgtcgtcactgccttcatcaccattgcgctgacctacttccagctggcggtggaggaccaccagtggtggtggcgctcgttcctgtgcggcggctccacgggcatcttcgtgtacggctactgcttctactactactacgcccgctcggacatgagcggcttcatgcagacgacgttcttctttggctatatggccatggtctgcttcggcttcttcctgatgctgggcactgtgggctggcgcgcgtcgctgatgttcgtgcgccacatctaccgcgccatcaagtgcgagtaa

SEQ ID NO: 69 - DNA, 941 bp, Chlamydomonas reinhardtii
atggaggttatcaccgctgtcaaagcagtcaaagctgctgctgcctctcgcggcgtgaagggcgtggagttagggcagctcatggcctgcctggcctcgatacctgctgaggagtaccgcgccttcattcttccaatagccgatgaccccgaggcggtctttgcgtacgtgcaactccgttacaaggctcaaggtaggctctccgtctgtgtcgctaccgtcaagctgtctgggttttgttggccttggtgctgagctctgcgtgcctcttgcgcaggtgtggggtttggctctcacaacagggcgagcatatcgagtgagtttgggtcagccagctccatcaaacgtcgggcgcgcagggtcactgtggggcgctaccgcggggctgggcttgtggggggtggcaaggtggcgtcgtgtgcgcaacaagacaaggttgcaaggcgcctaatgtcagaaatggacgggtgtgtgtgtgtggtgcggaactacggatcttgagcagctctgcacagcagctctgcacagcagcctcactgcacggcaagggcggggcccatgcgcccaccccctatgtctgtggccctttgcagcggcgccggctgtcggagctcgcgcgcccactgcgcagcagccgtacgccgacatggcgatgctgaaggacgcgctggcggagcagatgcggccgctgatgtccaaattgcaggaggtgctggctgacaacgcggcgcggcatcaccaccccaactgggccgacgttcgacgggagtgggctatggtaagcttgaggttttgccaggcttcggtggtagactctgacattgcacgacggattgatcctgtgccgctttcctaaccatccttgcaacgccccccccccccatgcactgcgaccctagcagagcacggcggcagtgcccaagcagaagaaggtgttgtga

SEQ ID NO: 70 - DNA, 5211 bp, Chlamydomonas reinhardtii
atgggctgtgtcggttcgaaggaggatgctgcggatgttgcaaaggcccctcccaggtagctgggaaagcaaatcgcgaccgggccgagtctgttggtcacgcgatgggcgggttgctgaccaacgttgcacctgtttgcagggccgaagccggtaatggcaatggacatgtagatgctgtaaaagctcaagcagccgcggcacagccggcccctgctgccgcgccagccccagccctgctggtcgaagcccctccaccggccccgcctgcagctcaagccgctcccgcagtgccaacgccccaacccttgtacaacgggccagatcaagggttgcctgcaccgcggcaagcacctccaccggccccgcaaggcgagtcagcgagggcagaaatcatcgctgaaagttttctaattttaacggtttcgcaggtgctgcgcctcctcctcatcatggaccaccaaggcgggagcgttcagagttaaagaagcggcaggggacggaatatgaggaggattcggactgggaccagtgctccacagcaaacttcaacgttgacgaggatgcgcaggccaaaggtgagtcacaagttaccgcatgggtccattaaacctggctaagaggtcccctggccgcagattgcgaggtgccagcggtcggggcaagcgtcatggagaaggcgctgcacaattcgctatttgctcaggagaagcacgtgcccgggccggacaacgtgtacaagtacgtcgtggataaccgggccgcaatgtcacttacagatgtattgccccagagcgctgaactcgctttttcttggctgttcacagggagacgacgacgctgcgcatagacaaagtgaaagggtgcatgtttgtgaaccagtacctggtggtccgtttccttggtcgcggcgcgtgcggcaaggtgttcctgtgcctgaacacgtacgacctgcggctgtacgcgatgaaggtggggggggggggcgcgttgatgtaggatgtcggggagtgggaggtgcgcagagaggtgcgggcacagggtcaaagtggtattggcagccgccgctgcaggagtacggcgtggaggggaggcaaataggtattgtcgtgctgggtggcgacgggagacgggatgaatgcggccgctgaggagagggtgaggggacctcagagaagctcaggcaggggcgccagaggcatgacgaaagtaagggggagggctggagccggggagtggcccggacaaagccgggaaacaggcgcgagctttctgtgcaccctgcgcccccaccaacacacacgacacgtcatctccttgtgtgcctgtgtggcggcccccgcctgcctgccccacttcaggcggtgcgcaaggtggacctggagagctcgcagccgccgcagcagggcgccaaaaagcgcaaccccatggaggacctgaagcgcgaaatcatgatcatgaagaagatgaagcacaccaacatcgtgacgctgagcgaggtgattgacgaccccgccggctccaagctgctgctggtgatggagtacatggagggcgggccggtgctgacgcgcgaggcgctggagaagcgggagcggctgccggagagcctggcgctgcagtacttccgggacatgatcaaggtgggctggggggggcaggaaagggcggagggggagggggggagggagggggaggggccggggggagaggggcgtgtgattggggagggaggagaggggaggagggggaggagaggaggggaggaaggagaggggagcggagtcgaggggaagggtggcaaggggaggaagggaaggagagggaggagaggggaggggagggcatggggaatggggggggggtaatacgttccaggacccaaagcaagccgaccgagtgagcccaggaggggagggggggggatggggaaggggaggggaggggagcagaggggagaggagaggagacgggggagggggtggcgggagggaacgggaggggacgggaggagggtggagggaggggtggagaggcgagaggagggcaagagagggaaggagagagggtgtgtggagggagggggcggaaggtggccggaggaaggggcgaaaaggcggtttacggcgacttggagggaagaagggtttaagattggccgtagattcgttgtagctgtggcagacggggatgggatggtatggtgctggtgggatggtattttgcaggagggaagctggagaagaacccagggcaggagcgacgaggggcggcacatcatggctggctttcggaaagtgtctggaactgccgtcaacgcggccacggccagcactagcagcaagggtcttggggttgacggcggcccaggccagcggtgcccggaggcgcgactacggtacatctcctcaaacacagatgccgcggccttatcagaggctgccttgagcctcgtaacagcatacgaccaacacgcggccactccctctcatcctaacgctctccctcactccctctacatataggctctggactacctacacggcaacaaggtggtgcacggcgacctgaagccggagaacgtgctcatggccgccagcggggaggtgaagttgtccgacttcggctgctccaaggtgttcgccaccggcaacgagtacctggagcgctgcaacggcacacccgccttcctggcaccggagatgatgaagcccaacacgcgctaccggtaaggcgggcgcgcgaggggaggcagggccggggcggaggagggcgcccggggctggggggcagggcgggaagggaaggtatagttcgtaccctacgcaataatgcagccggcacgccaccttctgcaactgcgagctggcgttggcgcctcaggccagccatgcctggccatctccgccgtcaccaccaccaacagcattgctcaccaactccctccctcctctctgcctccctccctgccgtcccttccccccccctgtagcggccggcccacggacgtgtacgcgctgggcgcctgcctgtacacgctgctgttcgggcggatccccttctccgcgcccaacctgtacaagctgttccaggtggtgcagaacgagccggtcaagtacccgccggacgtgcccatcaccgaggagctgaaggacctgctggcgcgcatgctcaccaaggtgcggcgcgcgcgccacgtgtgcggggcactacgtacatgacgggggcgggggcggcgcgaggcggcggcagatggcgcacgtggcttcggtgatatgttcttgaatgtacatcgcggggagccgcgtgcgtcaggctaagtgcggtgtggcgccacaaacgccggcggcccggttccacacgcatggattcggcatgcgcccatccgtctttgccctgttctctttggcctgtcacagaaccctcgcgagcgcatcggcatgtcggagctgatgcgccacccctggctcaccatgaacaaccgcttcccgctcaagccctaccgcgagctgcgcgagggcgagagccaggagatgcacaacggcgtgatgggcggcctgacgtttgcggaggccaaccccaagcccgacttcctcacgggcctggccaacgtgagccgccacgagcgcgtgttccaggagggcgacatcatcatgcgccagggagaccagggtgagtgcggacggcgggggctggggcagcgggaagttggacacctccgcgcacacttgctcacctacacgccgcaccgctgttccgcgcgccgcaggcacctacctgttgtacgtggtcagcggcaccgtggacatcctggtcaagtgggtcaccatgccgcgccgcaccaacagcgcgcaggtggcgcaggggcagcagggcgtgccgggcgccaagcccgccgccaagccgggcgcgggcgtggacgagatgatggaggacagcgacaccatgtcgcccattgtggacgaggagagccgccagcaccgcgtcaacctcatgcgcgccagccagaaggcgggagagttcgtgcgctcgctgcaggccaatgcgggtgcggcggggcggcggggcggctgggcactgttacgtcgtgtgtgtgtgttggcgtgtggcgggagggcggcgggggtgctgggggatgggagggcgatggtagagaggcgcaggcagagagcgccatttcggcgtgcgtttcggcattgcgcagcttttggaatacagttaaggatgttgagctccggcacggggacatgtgaggctgaatgtgcgggcgctcgcctcgaaccaccgcaggcaccacgcgagacctgctcattgcccagcgcggccccggcgagctggtgggcgagatggcgctgttcagcaagagcctgctgcgcaccgccaccgtccgctgcgccaccaaggtggtcacgcgcgtcatcacgcacgagcagctggtgagggctgccgggggggcggcgtcggtcgaacctttaccgtagtgtcgcgactcctggggctgcgggatgctgctggatgccgctgcgggaccgcgtcgtggctccgctcgttcgtcggcaccacaggccgcggccgctggcttgctgcctccattgcgcgcggacttgcgttgacgtgccagcatctgtgcacgccctaccgcctccggtcttgctgcaactgctgctcacgcaccctcaacgtatgttgctgctatcaactcgcccgcaccgccgccgccgcccacaccgccgccgccgccacgtgcaggtggagtacgtgatggccaacccgctggccaagcaccaggtgcgcgaggtgatcctgaagaaggagagcgagatcactatggtggaggcgctggtgaagctcaccaacgtgcaggtgaggcaggaggaggaggtcagggcgggggttgggtggggggttgtaggtaccagccccagactaatacgaaaccagtcgaaaagagcaggggggtcacaaggcccagagcgattaggtcccatgttgttattgaatgggggccgccaggatggtggaggcaagcaaggcgaagcttttggttgcatgccgtattggcgacccgaagcacgcaaggaccgtacggctagaggatgccaactggcgccttgtgtggtgacaacggccctgacgcgtgtctgcaccccgacattgccacaccaccaggacgtgatcacggcctcgctggagcaggcgccgcagttttaa

SEQ ID NO: 71 - DNA, 1567 bp, Chlamydomonas reinhardtii
atgggtggcgagaagctgcttgaccagatcttcaacctaaagttcaccgccaagcagcttgcacgctcggcagtgaaatgcgagaaagaggagaaggcagagaagttgaaggtgggggtttgtgggcgcgctgggacagcaggcttggccggggcagcggcgaagtggtggtttgctggtctctccatgccatgccacgggtgcgggggcaacagggggagcgggggttgcactccggacggcatggtatcaccaggggcaagggctgctgcatgcaacggtcggccacttcctcatctgcacccaaacacgggcccaccccgatacttcccacctctgcaggtgaagaaggccatcgagaagggcaacatggagggcgccaagatctacgcccagaacgccatccgcaagaagaacgagcagctcaactacatgaagctggccagccggctggacgccacagtcagcaggctggagacgcaggccaagatgcagatggtgggttgggcggtggtggtgggtgggaagggtacgggggagggggaggagtctgaggcgccctcgtgaagttctgaagggtgaagtggggactgtgaggcagggctcagcgtccgacgtacatcataggagctggtagggcggtagatatcgccaccggatcctcggctggtaaactgtcccgcatcaaccccatcatactgctgtcacgcgtgccgtactctcctcccacccgcaggtccagaagaacatggcgggtatagtcaagagcctggagaaggccatggcctcaaacaacctggagaccatcgcaaacaccatgacgcaggtgtgcgggtgtggaggggcagggcgacagggcagggcagggcggcagcggctgcaggcgtcgaggagcaggccaggaggggcagggcgccacacatggaggtggccgggagggcaggctgcggctgcggtagggttcggggaatgggcttgaggaactttttcgtactgcagcgtcgcaaacataccggtactgtataccacggcccctgactggagttgtcactgttgcacctgtaaagaacgcatgcatcatagtcatccttcctcaccagtgaaccaatccctgactttccccgcctttcctgcctgcctcctcccctccgcgccctccctgctcccgccctgcagtttgagaagcagtttgagaacctggacctgcagacgcaggtggtggacgacgtgatgggcgcgcaggcctcgctgtccacacccgaggacgaggtgtcggcgctggtggcgcaggtgggcggctgggggacggggggacggggtccgcggcacgactggatggtgccagcatcacaatacctggtcttctgtgcgttctggacactcatgtactccccccttgtggtgcttgatgctggtgttgcctcctgctgcgctgcaggtggctgaggagcacggcctggagctggcggtgggcatgccccacgccgccgccggcaccgcccgccccgccgccgccaaggccgaggacgacctcaccgcgcgcctggcggagctgcgcggccggtag

SEQ ID NO: 72 - DNA, 4335 bp, Chlamydomonas reinhardtii
atgccgggcgagggagcagctggtgcagcgggcgggggctctgggcgtgcagcagaagtccggctctacgtcgatttcatgagtcagccctctcggtgtgtcgttatcttcagcaggtgcgtttgaaggaacacacatggttttggaggatgttgggtacgaggaacgcagtaaggcaaggcgcgaggttatggggaggcgaggggccgtctagggtttcgacacgtgcattccacgccgtcctgccgagtttcgcagcacgtcggggatggtgggcatcgggactgcggcgccggctcccccggtggggctactgcaacgcatgttgcacttaaaagcgacgcgccacacctgtgtgtttgcatccactgctgctccctcgaccacacacctccctcacgtaccacccagtgccgcactcagtaccgtacccagctccgtcatctcaaaaccctcatacgacatactcctgcgctcctccgccggccccgccttccccggcccccaaaaatcctccattttccagggtaaacggcctgccagtggaggtccgacccatcttcatacacaagggcgagacacgctcccctgcctacttggcgctgaacccgctgggcaaggtatgtgtacggcaccatgtgggtctcccctgtatatgtccacccaagtcacagcgcgtcacagcacgtctcagcaagtcccagcatgacgtcgcatgcctactgtagtacggttagccacacgcaggcgcatcagcgcttgttgatatcacgcgtacacacctagcgaccccgcgctgcgcccgcgacttgcccgatgcctgccctcaggtgccgctgctggaagacacggccgcagctgcctccagctcctccgggcccggacccggacccgccgcagccgcgggcggagctggcggcagctgcgtcctgcgcctgcccgagagcgccgccatcatgagctacctcgctgacaggtgcggactgcggcctgcggaaggaaaggggaaggagtgctgaggggggaagtaaataccagcccggtgaatactagcggagcacaggcagaggtgacagttgcaagcgatgatattagggtgggttgatgtgcgctagatgtgaggcgcaaggcgcaagcaagcgggttgataagtatggcatccctgcgcgcttgccatgcacaaacgcacacaaacacgcacacacacacacacacacacacacacacacacacacacacacacacacacacacacacacacacacacacacacatacacacacacacacacaaacgcacatgaacacacacacacacacacaaacacacaaacgcgcgctgtctttgcgcaatgttttccttgctctctttcacacacgcgcgcgcgcgcaattgcgccacgcatgcacagtgtcggcgtcttctccgttggcctttcacagctacacgatcccccacacgcccaccgcaccgctcccgcaccgcccccacaccgccccacacgcccccacaccgcccccacacacgccctcgcaccgcccccgcaccgcccccgccctcgcactgccctcgccgcaggttcccgggccgtgtggcggagcactggttcccgcggtcggacctggcgcaccgggcccgggtggaggcggcgctgcactggtaccagggtgaggcgcggcagtagcagcagcggctgggagagtgtccgtgtgtgtgtgggggggggaggggcgtggggggtatgtgccggggcccgatgaaaactcccatcttcatcatccgcgtggggacacgcacggagtggggagcggtgcagtttattccaacctaaaggcaccaaggtccaggaccagcccacagagtacggaggagtttgggccttagtgttggggtagttgctcgcggtacagtaccaggaagaagcaggaacttagggacgcagcccgtgacgactcacaacacgtacacatacctgtgtgtctccatgtagtggatgtgttctgcctttctcttctcatcagccgagtgcttgcctaggggcggatcacccgctcggccctacggtgctttggccaggagtggcggcagcgtggtggccctgctgagcctggtgtgcctcgctgccgcagtttgtcccgagtactcaatcactcgacttgaggaggcaaccgtgtcaccgtacttatgatacacacgcatacacacacacgtacacacacatacacacctcaggcaatattcgtgccggcgccgccaagctgtcattccacaaggtgattgccaagcggctgggtgtgcccagtgacgagcgagtggcgttggacgcactcaagacactgcaggtgggtgtggaactgtgcatgtgtgtgtgggcatttgggtgtgtggatgcggggtagttatttccaatcccagagaaaccgagacccggattcagcccagacagattccctggatgctcttgagcctgtactcttagggggctgttagggaagtcagtgtgtgaacggatgtggaagtgcagctctcgcgtgcgtgtgcgctggcacatggccctcgacctctcgtgacacaagtgtgtggggactacggggaccattgcttcatcatgccgtcgtgcactaccgtaaaacacacgctcgcgcggtctttccctgcagctggccctgtcggcgcttcaagacgtgtggttgggcggcggtgtcaggtgaggggtctccgccgccccgcctcatcgccggcctcaccgtaaaacactctcaaacctccccggacttcaagcagttagtggggccacatggactcgaacccctgtgaatgttgggcgggcttgttgcctttttcaacaaccgcccacgcacacgcacgcacacacacacacacacacacacacacacacgcacacatacattgtcgcatacactgtctttgcgcactgtctttgcgcaacgttttccttgtgctctttaaaacacacacacacacacacacacacacacacacacacacacacacacacacacgggcacacgccctttcctgccagccgagtcagcccgacccagcgtctctacaaccgccgcccgccatgcgccccatgcagccgggcgctatttgcagccgcgcggccccagactccttccctttcacgggcatagttagtgggtgggctttgggatgcgtgttaggacattagatagcttgcttgctgcacgccgccctcttccaccgctgccatttcacatgtccgtgacacttctgtgctgccgcccaatgcctttccattcccatgcttataggtgagctcgactacgaccagcgggcgggaatacgggaattaggcgtgctgggtaaacgttgtttagcgcgcccagggtgcggagcatggacgcatacaggtgcatcgcggggtcaggccgaatggtcgcccgtggggttacaggcttatcgcgggtaagtatgactacctgggtgacgacaaccacgcgacgctcggtaaattggtaggtatccgtaagtaactccggcgtcgtctgggcgggctttcgtttcgttttttaacacacacacacacacacacagcccgttccacgtcctacctctgccacgcacacacgcgcacacgcaggcgcttcatgaccggcgagctgccgtgcgcggccgacctgctggcgtgctgcgagctggagcagctgcgcatgctgcgtgcggttgagcacggcacggacatggaggccctgatggcgccctacccgcaggtgggtgggtgcgccactgcgtgtctgtgttaaaaagacagaaggaaaaagtctcgcaaagactgtatgtctttgtgagttcgtgcgtgtgtgtgtgtgtgtgtgtgtgtgtgtgtgtgtgtgtgtgtgtgtgtgtgtgtgtgtgtgtgtgttaacgagcacacggaatgattaacgtgtgtgcatgtgttgggagagagggccgacaaccgtgaacgcgcaatgtgtgctgatgctttcatgtatgcgttggcgtgcatgtgttagcatgtgtgtgcgcgcgcggcagcggatgggtcaccgctggcttccggcctccgcactgcacacacatgtcgcaacctgctggtggggtgttgcgtccccccccccccgtggcccccacgtggcccccctccccgcgcaggtgcttgcgtggcagcagcgcgtgcgcgatgccacctcgccgcactacgcccaagtgcaccgcgtgctcatggcggcggtggcgcagaaggcggcgccggcggggtcgggggcggtggcgggggcgggggcgggtggggcgggcggcggcgcggcgcagagcaagctgtga

SEQ ID NO: 73 - DNA, 5783 bp, Chlamydomonas reinhardtii
atgtcggcatttgaggagctgggcgtcatgccggagctggcaaaggcggtagaggacctggggtggatgtgagtatggcgcttgggtgccacgcgtgcacccgtacgggggcgcaggccacggcagctgctgacacaagccccgccactcactgcttgtgcgggctgcctcctgctgtaatctgcgtgtgtgtggagggggggctgcaatccgagggggaggctacatgggctgccctcagacctgactgatagtacctgatggtctggccttcacctgacataccccacatccactggtgtgctggcctgtaggctgccctcgccggttcaggccgaggccattcccctcatcctgggcggcggcgacgtcatggcggcggcggagaccggcagcggcaagacaggcgtaagtgtgggcttaagcagcgagcaggcggtaaggaatgacacgggccaaacgccaaaagctcatggaagcgtctgcaagacaacaccgcggtccttgccgtagagcgtgaattgcatgacggggtcatgaggaggtaaacatcgcccccacgacactcagcgaccagctaaatcacacgcgctgcacgcatgcgcatgcaatgccatcgcatgcacaggccttcgccattcccatgctccaaatcgtgcacgagactctgcgccagcgtgcgcgcagcggctccgccgccagcaccagcggccgcggcgcagccggggccgcagccgcagccgccagccccgcagccgtgccgtgtgtgctgagtagcgaggaccgggagctgcacgtggcggtgtcgccggacgggctgtcggcacagagccgctcggagaaggcgtggggcggcgtgcgcggcagcgtgggtgtgttcgccagctgcggcggcaaggtgtactatgaggtgcgtcgctgcgggtccatgacgggggcccggctggagagcgcgtggggtggtgcgtagcgctgcgtgctgagtcgctgagtactgaccaggaacggcgtgcctaactgaccgcaggtgacggtgactgacgaggggttgtgtcgagtgggctggagctgccccaccgctgcgttggagctggggacagacaggtccgtgtgactggctagggagccgtgcagcgcgttgcgtcctgctgagtaagctggtgctttcaaagtcgtccgcgtctgcctgcccctgcacttgagctgccctgaccggccctgccgtgtcctgcgccccgagcaggctgggctggggctttggcggcaccggcaagaagagccacaaccgccagttcgacagctacggcgagccgtgagtgccgggtgggcggggccgcgctgggacgtgcctctctttctgcttccccagctcactgtttgtcaacgttgccaggcgtcggtcgccatgcccctgcatgactactgccgtgctgccctgcgcccaggttcgccctgaacgacgtggtgggctgcctgctggactgcggcgaggccggcggcagtgtggccttcaccaagaacggccggccgctgggcgaggcgttcaagctgccagacaacctgcgcaaccaggtgcgggccgtgcgggagccgggcgccagggctcggctggccagggttggaggcccgcggactgggcgttgcggaccgcgctgtttctgtttatgagcgccgtgagacttcgcgtacatagtgctgatttgtgtgtgccggcccacgatccaaagccaatggacacgtagcgtccgcctatgcgcaacgtcggacgcacgcccccatggcggcgtgacctctacactggctgattcgatgctgctcacgccgcctcaggttctgcaccccgccataacgctcaagaacgccgaggtcgcgctcaactttggcgccacgccgcttgccttcccgccgccgcccggctacatcccgctcgctcaggcgccagccgcctgggtggcggcgggtggcggcgcagccgccgccagcgcaggtggcggcggaaacggccgcggtgagaaggaccttgggcgcaagcctgtgtgccttatcttggagcctgccaaggacttggcggagcagacagccaactgcttcaacgactacggcaaacacctgaaggcgccggaagtgaagacggggctgttcgtgggcggcatggatgcagcgccgcaggtgggcgtcaggcgtgagggtgaaggtccaggccgtgccgtgcacatgtggtccaacactccaacggggctgcgcggcccgcgctggcctgactgtaaggcgttgctgtactccccccatgtccacgaaacaaattgtgatcaatacccccgctccccctgggcgccaccagattcggatgctgcgtgagggagtggatgttgtggtgggcacacccggccgcgtgatcgacttcgtggagagcggcaagatccctctagaccaggtgcggcgcggcggggggtgggaggggatgtcagcaggtgcctgcgctcgcccgtcacaccttgcttcccctagagctcacggcccacctcgcgtgtgctgtgttcgcagatccgctttttcgtgctggacgaggcggaccggtgaggcactcagccagctgtagtgctgtgtctcattgcgttctgcgcagcctcatcttgtcccaatgcatgccccagtgtgccgtgtgcccgtgcatccctcccccgtcatccccatcctcgtgctcctccggcccggcccaggctcatcgcggacaacccggacgtgatcaccaagctctacggccgcctgcccaagcagggcaccggcattcacaggctgcaggtgtgcgcgccagaaacgcccctcgcgcaggcaacgcatctctgtacaccgcacaccttgccaaagccccctgccccccagacacaccttccacgccacctgcctccgcctgcctccgcctgcctccgcctgcctccgcctgcctccgcctgcctccgcctgcctccgcctgcctgcctgcctccgcctgcctgcctgcctccgcctgctgcctcaggtgctcctgttcagcgccacgctgcactcgcccgaggtgaaggacatggctggccgcatctgcatcaaccccatcctggtcgacctcaagggccgcgacgcagtgccggagaccgtcgaccatgtgctggtgagggcaggggcgagggcggagcgagggagggaggcagagggaggcagagggagggaggcggggcagaggaaggaaggcagggcatgcgcggcgacaggggcgatgagtcaccggtagtgatgttggctcgcaagtgcgagcagtgtgttgaacgaggtgctccatgttgcaccactcgggcgtgtgtgcctcaccggctgcaggtgcgggtggatccgcgcgaggacaggagctggctgcagagcaatcccgaggtgagacgaagtttggggcacgggcaagaggcgggccgagtgcagctgcgaaaaggagtccgccctgataccaacgtgccacctagggtagcagcagttcagccatggctgctcggctcacgtgctgcccacgccctctaccgcacccttcatctcacaccccacaccgcgcacttcgtgccgcgccgccccccacggccgtgcaaccaggtgttcacggacagctgccacgcactggaccgggtgggccccaacgccgcggccagccccgagtgcctgagcgagggcgtcaagcgcctcaagcagcgcctgctgcagcgcatcatagacaccatgaagatggagcagtgagtgggcgcagccggcatgcgtcttgcttgtgtcttgatggtgtgtcggtgtctttatggcgtggtggtctaccgtagcgtcagcgctgggcgagggagggaggcaagcaagggagcggggctgtgcgtctgaccactgctacgctttggcttgtggcggaagcgcctgaggggcctggcaccgcgcattccgcccccaggtgcctgatcttctgccgcaccaaccacgactgcgaccagctcgagcgcttcctcaacacgctgggcggggcaggcggcggggcaggcggccgcggcttccgtggcaagcgcgagagcggcaaggagaacccctacagctgctgcgtgctggcgggcgcacgcaggtgagcgcttgccgcacagcagcttccgtagccattgtgcccgccgttccctcgctctcactctcaggctttcccctcttcacgcctcgctcgctgttgatccctcacacgccctttatacgccgggccttaccctccaccccgccatatcctgcccctacgcctgctgtctacttcgctacacttctctgtaccaatctttgcaagcccccatcgcaccccaccgcactgcaccccctgctttacagcatggacgagcggcgcgccgcgctgtccgcgttcaaggacggggacgtgcgcttcctcatcgccactgacgtggccgcgcgcggcattgacatccgcgagctgccctacgtcatcaacatgaccctgcccgacaaaagcgaggactacatacacagggtgcgtgtatccttgtgtgtattcgtgcgcttgcgtgtctacatgtgtgtctttacatgcgcacgtgtggcaatgtaagtcggtaaatgtgtggaggcattgggcgatgtggacgtgctgtcacatgactgcgcgcaccggggccaccaggaggtcgggccgagtgatgctgggcgaaggaaacgatgccaagtcgcacagagtacacgggcatgactgctgccaagcccgcactgcccccgtgctgcatcacgacgatccacggatccgccgcactcgcaacaacgccagcgctttgcactggacaaacacacgtgcgcagattgggcgcgtgggccgcgccgacaccatgggtctggccatcagcctggtggccgaggtgccggagaaggtgtggttctgcaccgtcaagggcatgaaaccctggctggcgcccgacagcagcaacacgcgcaccacggacaagggcgggcacacaatctggtgagggctgatgagaggacgccaaggattgttggggtgtgactcgcctggcggagtggaaggctgcggaggacctggtgttggggcgggctttgcctgtaggattgcggcttgggtttgataccccacatacacggacaatcgaaaccaagtctgcaggtgcataaggtgcctatgaccaccgcgctattgccgccctcctccgcacacgcgcacacttgcctcacacgcccccacaacccacacaacacaaccaggtacaacgagcgcgagttgctgggcgccattgaggggcggctgggccggcccatcccgcccatgtcggacgacctcacgctgccgccggagctggcggagcggctcagcgcggcgggggacaagtacggccagcagcgcggtggcggagtcagcaaggaggtgggcgcgagggcacagagggttgtgcgcggggccgtgggagggatactgctggtgggtgcacgccatgcctgtcgtggcccttgcagcaaaggtgccgcggcgtcgagcaagccgggcgcctgtttcttcctttccagtcgtggccccgcaggcggcctgcccggctttccgcgcatttttcctgtgctcatgtccttaccggtatgttctctggttgccttgcgctccccccatcgcggtcggcccacaggtgacggagcacctggcggcgatagcgtccaacgtggcgcagctggctgggctggagtggcaggtgcaaaccagctacctcagcctcaaacggaaatggggctag

SEQ ID NO: 74 - DNA, 1879 bp, Chlamydomonas reinhardtii
atgctctcctgcagtgctctgtctcgcgcgggccttccacgcgcttcacggcaacccctcgttcgccgctctgacctgctgctggcaaggcagaacgaggcatggatatctgggcaaggtgagataaatggattgaaaatgccgcgacatcgcataactgtggcgtaatgtagagttgtagattgaccagcgctttgctgcggctgtgcgtgggtagcagaccccgtgtatgctgttaactggggttgggttgcttgctcgctatgccgcaacacgcgcttgccaaaccctatcgcgaacttcgcgtttcctcaagctcctgagaccgccccaatacttatgcgacttcccttgtgatttgacattgcttgtactgcatctgataggccttggatggtgcagtcgcgttcgcgccgtcgagacactcgctgcaggcccagccggcgaggcgatcgccgagcttatttgggagcttccggcaggcttggccaagcgtgttttcattgctttttgggatatcaaggagcaggtgagtcgccctatccggtagctggcatgtgtgaagggtaggccactgagaaggttggggcacccacccaggcagcatccacgggcagcatccctactgaagtattgatgatttggcagctgtccccagctctcacaccaagtgtgggctttgtgggctactcacatacatcaacacgtcgttgctgccatctatatgtcaggcccaaggtaactaattcgctgacacgccccttacgtcgccgccgtgcccaaccagctggcggccaagtccgaccaactggcggccaagtccgaccagctggcgacaaaaactgaggagctgtacaagatcaaggtggagctcacgcgcgcgctccacgctgcaggcgtcgtgaacgcccgcacgttcctgggtgggtcgatcatcgcgatggcaatgaatgcttgttgggtcccagtagtcccgtgggttgctttcttactgctggacaagcagagtgcagctgtaagggtgctcgtgtccgacactgccacttctgcagagtacgtggtgaagcagtgggagcacgagctgttcggctctgtggggaaggtgaaccgcctgaaggtcatcaaggcggggctccgcaagcgcccggagctggtgaagtgcctgcagcggaacgtgcccacctgggtgcgcgccggcatggacgaggagcggatcggtgcgtatgttggtagaggccgctggtgaaacctacagcaagcacgggcgggcagccattagcagttcttgatgcatcctctcgagggatggaaggtggagtggatgagttcattccaggaatcctaggcagtcggggggctggtggggttctcatggcatgtttcgacagcagcatattcagagcacgcttgtagctagcggtcgcaaccatgccccgcttgcactccaactccgttattggccgttcacttgacagtggaaaatatggccaagaacctggaggccatcatgctggactccagcaacaatgtgcacacgttccaccccgcgattgggctgactctgctcaaggcggcgcacagcgagcccatggtggctgcgctggtgtgcgttgcagacaacatgggagtgctggtcaaagtcattaaaatggtgagtaagctttttgtgaagcattgtgggcctcatcaagcctttgatcctggctgtgggtgcaaagacggttcgccagttgcttgaagcaagctgcaccaagaaatagtgcatgggcttgtgtcctgtctcacgcctgggtacctcgacacggacgcggtgtgtgcctccattgcatccatgcagaacgcgatgaacgacaacaatgacaacaacatctctgcgtga

SEQ ID NO: 75 - DNA, 8057 bp, Chlamydomonas reinhardtii
atgacgttggacctgctccttgcagacattgccgacggttcaatcttgacctcggggggcgacagcctggtctgctttgagaaaaccggtcagcggcgctggctgttccggttcaaccgcaagaccgaggtagtggccgacaatcagaccttcacctactcggcacgccaggtgtgtggcaatcgatgtcgtgtccatacggccgtcgcatgcttgactcgcggtaacaggctcggtagatagtggacggccagtagtgatggtgggatggacgcatgcggcctttgcttggggaaacgaagaagtcagcggaacaccaacgttgcgcaaggccttgctcgcatgtgcgtggctagccgaatggactgtatccttgcaggggagggcatgcagtgcttatcacccagccagcagcgagtggatggggtcgcggcgccacgccgcaagtttctctgcttgcgcgtggtacgatttgctctgtgtgcatacgtgccgctgcccctgatttactcaggatggtgccagcccctttatcgcggtatcgagcaccggccttgtttacctggccgccgccgacgcagttctgtatgcgctggtgggtagtgttatgggatatgaagtcaggcaatgtccgggcaagtcggcaggagtgggagcaggacgaagaggaagaggcatgcatgcatggaagggtgcggcttgggagcaggacggaaagcaagaggcatgcatgcatggacgggtgcagcttgggttgaaggagtaatgcgtgggtttaagtttgacgggttgaccacctcatgcgttccaacatgatgcaccgtccgcgtgcaccgccgcacgcgccgcacgtacaggacgtgcgcaccggcgacctcgtgtggcactggcgcgacagcccctccacatttgagtccatcacgtacggcgacggccgtgtctacgtgtccacaagtgggttcaggcggtggctagctggggaacagctggataggcaatgcccccgtggagcaagtgcggtgcgtgtgtgccggctggtaacgcagctgcttgcctgctgccatgcacatgtatggcgtgtgtaacccagtcctgcttgtgaccatatttgccttaaccccgacggcctgccgtgcacgcagctgatttcaagacatatgccctggtgggtgcctgctgttgctttgcatatgggctggtcggtgttgttaccgaccatacatgcgactccctgactgacgcacgcaactcggcactgtgaatgaatgcaaactgacacctgaatcctcatgatgtcgtgcgcttgaaatgcccaaccttgcaggacgtggtaacaggggaggttttgtgggggacgcagttccggcgtgtgtcctcctggaccaccggctggttcaagggcgtgtttgtgcgcccagacgtggacgggtgagttgcgtcgcactgtcgtggagggcagcctcgtgctcagctatggacttcaagcggcacgaggcattgcgcgcctcacaccacgtgttccctacatgtcagttttgatgtgggccacgcacaccattgtccatccatcggccttggcctggccatgcctgcctacctgtgccgccggctactgtacgtgcaggcgcgtgtggggcgtggatgctgaaacgggcgacctcatttggatgttcaacatgggtgctgagattcaataccggtgggacccggaactgcacttccatccctcgggcattggattcatgatggctcggccctcccagatctgggcatacaacgtgacttcgggtgggtagtggtaatacggctgctaggcgcatcgcgggtggacaaagcagggtcatttgcgaaccgtgcgtggcacacacgttcaacacgaagcggtagcgccagcgtgtgcatgcgtgtggtggttggtgctcgcctgcccgaggcacgggaaggggctcgctcgctgtgttgcgtaagaagcggagcttggcacgaactggacgggtgcaagggcgggctaggcggtaaacgattgctgatgtgtgcgggacggccgcaccgcgatgtgaggacagggcgggcccgcacggcccgcacagactggcaggatcaaccggtgcaggcacgcgactgccagacatgatccctcggcagccgctctgccgcagttacgagtacgtttgcccctgcgcttacatgtcggcggtcacaggtgacgtcctttggaagatgaatgcccgtgagggatacatgtgagcaccctggcaggcatggggtagctagaacagaaggacaggtgcacccacgaccaccaccttgacacaccagcttgatcggagcacagccgtgcctctgccgttgccaccttcaagaccaatatcctttgtgaccccgcaggagccctgacaatgatggcgacaatcggcagacgttcgaggtgtggggagacctgtgagttgccagcgggtggtacatgccggccggggagctggctggggtccccagtgtgctctgcgtacggccaaggatgcattgtgtttagtgcacgtgagagtgtttgtccactctcggagtgctgctgtgatttctgggataggcagttgggacggaggctccgggactccgccggtgtcaaccgcggctgacggacacagggcacacaaggtgccaggtggcagtgaaaacacggcgtaccttggttgtgcagtaatcgtgccgtgttcgtacagcttgcattggctatgcctccttgacgtgcacgtactgctgttgcgccccacaactatccagggtgatcgctcaagatgagggcgccgttgaaaccaaccccaacaagtacggcatccttcaggtgcgacagtttacggcaccgattgaaccctgcatttaaaacattggcatgctttcatcgtcgccaaaccttctgagcggctcttgactcagtttacgcattactcacacgccaggctctggacgtgttcactggcgtgcgtgtgtggatccgcgacgacgtctacccggtgcgtggctggcgttcgttcaatgcatgcatgtgcgcgcgtgcactcgctgtcagctgctggcgtcactagcaggctgcgtgtgtcggtagtgagtgtgatgtcctggtgtggtacggaatgcacggcaaccacatgcatggttgtgccatgccgcacaggcgtacatgcatcaattacggtgtcgagtgtgtcacatacatgctcaacccatgtatgcatgctactgggaatttgtgcatgcatgtgcagggcaagtacggcatggtggtcaccgaggggctgctggtctacaccacctacataccggatatgtctaccctggacgtgtcttcttcgctcctggtgaggcacctgtccggtatgtagccagtgatggtgcgatcgaccgcagcgagcagggcagcgggcagggcagcgagcagggcagcgaccagggccggcttgcatggggcgacggtagcggtggcggcggcggccagccagtacccacgcagcgcgcccgtgagcattgtcgtgcggtgccacggtgcccggtccgcaacacatgtatctcctgctcaccacaacgcacatgacacgggcacacaacgccacacgccacacggcgccacacagatcagcgccatgggacccgaccaccaagacgtctggaactggcagcgcgatggcgcgatacccgccggccagatccaggcgctggacgggctcgtgttcgcgctgcaaggcgagatcgccaacaccaccttcaatggcttgggctcgtccacggtgctggtggcgctgcctgccacgcccagcgtcatttgcccgcccggtgagctcgttctctcagctacccacccgtgtacttcgcaaagcaagctgaatgcatggtgggtcggcacgagacttatggaggggtgcggtatcaggagcagctatcggcgacccattgcaacagcttgcacctgcagatgctcagcgtggacatgctgcatcgcgcgcgacccttttaatgtgtgccgctcgttgttttccccggcgcagatgtcaagtccccgccaatcactgtgaacaacaaccagcaagggaccaacgctgtaatagctccgccgccgccgccgttcgtgagcggcaagcccttctgctggacgtgagctgcaagggtcgcctgaggttgcatgacgtaacgcatcggaactcatgccaggcatattgtctgaagtgccgtatcccagacggttgcacgggtgcctggctgagcgcttgctgggatctcaggtgtcaggcgcagggctgtgcacctgggtgcgactacgcaagtcaaccatgcgcgacgccgcaccttgttccctgcagtcattcattctcctacaagcctctgggcagccctacctctgacggcgtgcgggcgtacggccaggacaacgcggggttggtcattgcagtgagtattggcaccgttttttcggtccctgcgtacctgcaacccccaaacaacaaacgttcggttgcttgttgcatcgttggagtgcgcaggacccgattccagcacatttctggtaagcaagacgagatctgctctcgccctcgctatgcaggtgtacctggacacgggggctattgcctggaaggccacttgcgggcccgatagcaattcgttatactacccatccaacgtggttgtggtggacggggtggtttacctgggctgctccaatctggtgcgttgagcaagaaacatgctgagcgtgacgcggctagtatctgtcctagtgccacccacctgtgtccgaaggggcaggacgaagattggggcactgtttgttgccgtgtgtccttactttataccacgctaaaaatgctcccctctcgtcacgcacgccagtgcatttgccgtgcgtgcttgttggctgggcttatttgctcttcccacaagcgctagctgcttattccacccgccataccggcctcacaggacgtgcaagcgcgggacgcggccaccggacacttgctgtggcggcgcccatttcagctgacgcccgaccgtgcggcgtacaggggcgggatcatagggaaccccgccgtggcgaacggcaagatagtcataagtaaacccgacggctttctccaagcgctcaacatcacgaacggtgcgggaacattgtgtgtgcgcgcttcagcgagtaaacccatgcggttgtgagtgccgtcgcgggaggcacaccagggctttggcgccagcattgactgttggcacacagcaagctctcaggtggatgcatgacccggcacgtctttacggctgccaccacgtgcacactgcgttcgtgccgtgcaggccagctcgtgtggagctatgatacggtacgatcactagggctgcacacacctgtgccttcctttgtccccatatcgctgcggtgatcagccctgctcacagcagttgtaaaaagcgaacacccgtttcctgtctgcctggtcctgactgcagggcatccttgcggctgactccgtggggatccgggatggtgttgcgtacgccattgcacgtcacaacgcggaggttcgttacagtaccatcgtggctgtggacctagacaccggcaagtgacgggttcgcgcgagaggatgatagtgctatagatgaactggcctgtggcggggtgacgtgcgtggcgcatgcttgcattttggggaaaggcaaatatggctggccggcaaggacgtgccctgtgatgcatgcctctggcgtgaatgctaagtgtgtcgcactcatgcggctgctgtggcgcctacatggcaacacatgcatacaggtgtcgaggtgtttgccaaaccactggagcccaagtgggccatggaacccgggcgtctcaacttccgacacgacaacaccctggtctacgccacctggtggccggacgcgcagcttcaggccaccacgtaagcacgcagcgcccaccacaagcccctcgcctccctccgtactacaactgcttgctgctatcacccactgctgcccaacaggatcggccgcgacggtggagaccttgcatggaactaccccatctcggacagcaccgggtgcgggtgtttgctccggctgctgctctgcgtgcaggggaatcggcgtcctgcaattgtcccaactgatcttgggattggggttgcggatggggcaaggcgggcggggcaggactgggctgggctggccagcactcctacctgctgttgcctaaagcgcgtgccctccgtgacttgctgcagggtctactcggtgctggtcgtgtcgggtgaggacctgggcctgccccatgacgcgctcttctacaacgacaacgagggcctcgtcaccgccctggctctgggcagcgatgggcctacagaagtcatgtgagttcacgaacggtctgtccagcttgccagctagcagcaacacgtgccggtggcagatgggcctaacgcgcgctcattgtggctagctagctggctaagctgctgcgctgctgctggggccgggctcctggtggctgacccgaatcacctgtgctcatgtgttacatgcttggcggagtgtcggcgcgctgcgatagaccatgcacgctgatgcttgcatgcaggtggacggtggacttgaccgacgcgaggttgtggcccggggtggagaacctgctcacacctggccagtccgactgggcgcaggtcggtgtggccggaggcaatcaaggggcgcaggcttggggtcccaacagccgcctcgcacatacacgtacattggctcgcaggctctggcatgtcatcagcgtttcgcagcagcgtgcaatgtcttggtgacgcacgcctcaaacgccaacagccagcatggctgccgccgacatgtcatacatcacgcacgcatgctctgcccacacgcgctgtacgtacccccgtgctgactgatccctgcatggccgccttccgcactcgcagattacctactctaaccagacgctgtacgtccccacgacccagggaatgtttgttgtcggggccacaaacggtgggtgggccgatgggaccgacctgctgcgcacactgtccgcacaagccgtgtcttctgcatccagcctgactcctgatgcgcacgcctccgcgcgccctggtcccgcaggtgaggctctgtggtccgacctgcgctcccgcctcaacgccaacattcacgtgatcgagcggccgggcgggccccaagtcatctatggcaggtgcgcggccgtaatgcgcgacagcacgtgtgctgcttgcttggtggcctccagcgaatcaggggtgtatggctaatgcgcagcgtccctcctcatctatttcccgtgccgtttcgcatgctcactctgccgcccacacaggtacctgtctaactttgagtccaacacgcctcagtgccggccccccaagccatccggccttgtcacaaagatctctgtgcgcggttccgtgcccgctgatggcggcgaggagccctcaacgcccacagacgcgccagcgcctgacagtcgcccggtgcctgtgactgcctccccacctccatcggttactcccgcccccgccccttccccgtcgccctctcctccaccatctccctccccggcgcccgtgcgctcgccgtctcgctcctcctcgcctccgccaccaccagtgtgcccgccctgcccagccattaactgctccgcgcccgccaagaggccctcgtcgcccgccgcggtcgcagtggcactgggtctgtctggcctgccgtacaacattgtgaaagccgactccaagctccgtgaccgggttgcgggggctgtggagaagctggtcagcggcaaggtgactgggttcgtgcgtgtgcgagtgctgggtgtggagagcaccgcgggcggcacggcggctgtgctgcgcctgagcctgcagcgcagcggcggtgcgtctgctaccgctgtggcgtctgcgattgaggacgcggctctgaatggcaagctacaggaggtggtgcttgcggccaaggtgccggccaaggtgcgcagcgtggtgctgaaggtgtga

SEQ ID NO: 76 - DNA, 1615 bp, Chlamydomonas reinhardtii
atggcgctgggaggtgatcggagttgggtttggggcatgacttccttgggtccttcttgcgcaccgtggcatgttggctgacggtggtgcgccagaaatcaatgtgttgggcttagcgcatgataagagggagatgcggcatgagtgcgggccaagccttggcccgcgcggtcgtgtgggtggtatggaggggtgcaagcggtctgggtacgccatagggcgcagcagcttcccaacttcagggcctcgctcagggccgttgactgagacaacccggtcataccagtatgtgccttggtgtgtgcactctgttgtgtacaggtgtgctgtataggcaagctgccactggctccggctcaggattcaaagtgcatggccaggctgtctccctgaactcccccggcacatctccgctactgccgctgctagtgctcggcagcacgggccttgtccaggtgtcggcggcctggacggggctgggggcctgccactggcacctgccctggctgctcaatgtccagctggggctcctggcgctactactggtaagggctggcacacatgctcggagtagccggagcatcgggctttttgggagaagtgagcttcttgggagttgttcaaggccaggccacgaccatcaattttagcgcaatacagccaatggatgacacagtccatgggcgacacgcgcaatgggtgacacagctttgctccacaccacctgtcccacaccacctgtcccacagtctgagtctttgctccacaccacctgtcccacactcccacgtgcaggccagccagatgtgcatcacggccgcagtggtgtcggcgtctgaagccaaagccggtattggccgggtggcggggctgccacacgcgccatccagtggacgggaggtcttgtttgacgcgctgaggtcgcactggggccccggcattgcggtcgtggcagtggaagtaggtgctgggcggggcttgatgctataggacccaagctcttcgacgcatgcactgacatccctttcacgcccgcatgcctagcgaagtagcatgcttgaagcataagccaacgtatctgactcgtgttcttctgagcaggtgacaacattgctcgtcgcgtgtttgctacacgccatgtacatacgggcaggtgcgcacccggcgtcctggattacggatgggatggctctgagagatggtgacgtatgtgtggctagcgtcaagccgttgctgacctcttgcacctacctcatattgtgctgggcccgcagacgaagccgcggaagaagcggaagagctaggagccacccgccagggagatgcatcagcgccgttgcttactcctaggtgcgcagctgcatcgccgacggacactgtgtgcacacgctggccattcctaaatgaaccatcgagcttcgttgcagacacacagtatatatcctcgaagcacctcgggaccacctttgcccttgcatgcctgtatgtatgtgtcgtacatacggttactgtcatgatccgccccaaacgcaggcgcaatgaacatatggcgaccagcggacaacggacgggcatcgcatcacagcctacccgacatgcgagccaacgggtgtga

SEQ ID NO: 77 - DNA, 1534 bp, Chlamydomonas reinhardtii
atggccgacagctcggcgcccagctccttcacaattctagcaacggggcaactcgagtgcgctgaggtgcgggtctcttgcgcgggggcagcgggccggtgtcgcggcgagggaaccacgctggattctcgccagcagcagagggggcacgcagccgcacacacgctcgctcattccacctgctgtgtacactttttcagatccccgagtgcaccaacgcgtacctgaagttccaatttgttgccggcgaggactggcaattactggatgggctagaggagggcatcacgcaggccgcacgtgtgccagaaggtacgcgcaccagccccaccaccatcaccgtcactgcagtaacctgctaggtggcctagaagcattgccccgcaactgagggcaccacctacattgactcttctgtacggcgcgcaggtcgcgacggcgtactggtctggaacttccccatcgacatcacatacaagaccacgaacgcgttcgggtggccgcagctggtggtggcggtgtatggcctggactcgttcgggcgtgacgtcatcaagggctacggatgcatacacctacccatggcggccggccggtgagaggacagcggacggagagcgagggtccgagtgggccttggccgcggacaacccagggcgtataaggcaggacaaacggcgcatatgttgcgtggttggtaggctgcgtataaaggggtgcatagcaccacagccggcaccatagcaccacagcctagtgccggctgtggtgcattctgggtgctgcgcgttcacgcctgaatagctggggcctggtgcctgagcactttcgcttgtgtgcgtttgtacaggtacacgctcaagctgcggctgttccggccgcgctcggcgtcacttctgcagtcgttcacgtcgtggctcacgggcatgcccgccgagttctccgaccccaagttccccagctacggcgagggccgggaaggtgcgcgcagtcgggaaacacgcagcaccagattgttacttgcgttggcaagcttccgcgtgcgacctgacattgacagaagacgaagtatttcacgtgttgtgtttgctgccaccgcagtcacgcgtgtgcagtcaggtggccacgtcaaggtgcaactcaacctcatgaccaaggtgcggcggagggaaggggccagtgggcgagttcccatgtgtcctgcgttcgggttaccaaagcaggcgtcgcagtgtgcaggaactacccatgccggtgtctgggcgaggctgtgaggtagacatgtcgctgtgtcagtgaaccatgcgcccagccccgccacgataccgtgtcctaggccacgagctcgctgcgccccgctctggcatcaagtcatcaagttggacgtgcctgcttactgcctgcttattgtgctacagccgcgggctctcaccgctccgcgacacacgaccccgcccgacaggacatggacatgttcggctacgtggacggcagcgggagagaccccgccgtgagcgccatcacgcaaatgtga

SEQ ID NO: 78 - DNA, 8043 bp, Chlamydomonas reinhardtii
atgaatatcagttgctactcgtccattgtcaaggagtcagcgcggtgagactggagtaagactggagaacacccaaaacctttgtgcaagtacaatcccatgacacctgtgacctgcaggagcctttcaatgcaaagctgcttcaactaattcagacggatgaacggctgacttcggcactggatttagcggcaaccagcgcaagagctggcaagccattcgcctgcaattgctctgctgatgcgctgcagggtgggagtgtgctggtaagattatatcttttgatcttcagcgtccagccaaatcattgatgacagcttggccttgtatggtccaattgagccggggccacagtcgcactcagcgcctcgcaagtgtttgtcttaaaagcctctgatgaatgctacaatgtgctggcagcgggtgacggcgggcctgccaggacggtttaccgccaacatcacaacagaagtcagaaagtgtgcgggcccctcgtcgcaaattactcactaaacacctgatacgctgtgccgtggccatgcaggttcgcgcttgcgtttttaacgatgaccaggagcatagccagccggcaccagcggtgttactaatatgcgggggcgttcagtcgcccgcacacctcgcgccagcgccagtgaggtggggccctttcctccaatcgggcttgttcggcgacctgccgcccaccccgctgcggaccacaccggacctgctgcgcttcagctctctggggctggggctggggctggggctgcccggcgccccggcccagcagcagcaccaccaccccagtggcgttcccggcagcggtgcgcacggcgctcccagcctgctgcccacctccgtggtggactcggccgcctgcgccgtgacggtcgtgtcctggtgcagcgctagcggccgctcagccatcatgtaccaggtgcgagtgtggaaagtggaggggcggcgggtggggacttgtggcttcgggagtttccgccggggcagcccaactgatacgtgtccactccaccgctgaggcgctgaccgcaagccgcgtctgggaccttaacctgcaacctcccaatgatactcccccacccaagcaccctgaaacgcgccctcgtgcctgctccgcaactgcatgtgctgaataccaaatgtgcatgtgcgtgtggttatatgtgtgtacggcagaacgcccggtccgtggggctgtacggcagcctggccagccccgtactgcgcacacgtggcctgggcgagctgttgctgaggcggctgctggccagctccggcggcggctgcagggccggagctggcggtggcggcggcggcggcggcggctgcaggacgggcacggcggatgccgctaccagtgcggctgctggcgctgccttggggaccgcgcccagcaccaccacgtatgaccggagcaccgcaggcgatgcctcggtcggtggtggcggcggcggcggcaggcacacgggcggcggcccggtgatggtgatggcgtcaaccgccgcgggcggccccgttggctggggcgcggacgtgtggggctcgggcgacgcagaggctggggcggcgctgctgcagctgctgctggcggtttcggcagggcaggtggggcgctgaggcacggggtggaggcggctggggctggggctggggctatgccggtggctggttggggccgctcctgcgggcgaacgctgtagcgtgcaggatgggcgccgagtgaatggggctatcttgtgggcatggcgctgcaccgtcacctgttgtttccaccacaatgcccaacgaccgccgccttttccctgctgacctgtgcactcgctgctgctgctgctgctgctgctgcaggagtacgagtgcctggtccaggtggagccggaggcgctaggcacgcagctggcggcagcagcggccggcctcaccggcgccgcctcgccggcacccgcgccctttctttcgggggccggccccaacatggccagtgccgcgggcgccctggccagcggcagcagcggctcggctgcagcggggtcgggagcggcagcggcaacaggcgcaactgcgctggccctggccctgcgctcacgtccgcatggcggctcgcgctgcggcgcatcagcggcggtggacgcggcggcagcggcgctagcggcagcgcctgtgtcgtgggcgggagaagctgcgcccggggcagatggtgatggccgcggggaggcggagaggtatcccgagctcgacactatagacgcggcgcttctggaggcgttgttgggcactccagcacccgcgcctgcgacaggagcgcgcgcgggcggcaggaatgccgctgacgcggctgccaccggcaccggaatgagcgcagctgatcagcatgatcacccgcaccaacagccgtaccgccgtcatcagcagggccaggggcagcccatcagcgcttccggccgccgcgctttcacccacgacgtgcgccgcccgcgcaatgacccgctgtctgacgagtcaggggccttcgcgtcggcagctggggcagagcattcagaagcgtcggctattctcgactccagccccttcatcgcagtgccgacacccgcgcagacgccccggcctcatgctccaacagccggcgaggtggtgacggcggcgtgcgcgcctgccgcgcccaccgctgcggcacatgacggtggcggaggcggcgcgggagcgcatgcagcgctgcttggcaacttcgctgctccccaaacctctgccgctgatgatgccagtaccgccaccgccgccgccgcggcggcagcagcagcagcagaggcagctgctgtggagcagtggacggtgtgcgcccgcggcggcggaggcggcggaggcgaggggttcggctggcgccgcagccgcacgtccctgccggcgacgccgcgcgcccaccccgctgtagcggcgcagctggtgggctcgggcgtctcgctccacacagcccaggccgcaatagcggaggccggcttgcttccgtggcgctcgcagtacactccatcagcgggcgtaggccctctggaggcgcaccctatcgcggcatcagcggcagtgaccaccgcgctcaggccccccaccactacgcccaaccccacgcagcccagccagtccctgcccgcgagccagtccacacgcggcctcatcaccatgtcgccttacacaaccggacccgctggaatgagtcccgctgacctgtcggggccgtttgcgatgccgccgccgccgctggtgtcgccggcggcgtcgcggccgctgccgccgctcgggattgcctcgaccgtgtcaggcagcggcggcggcggcgcctcataccactctggactgctggcgtgcctgacgccgctgcaccgcggcggctcgcggccgcaaacactcgtcatgtctcagctggtgcaggccggtgcggcggcggcggcgcagcggaggcacagcatcggcggcgccgcgctgcgtcgcagcctcagcgccagcggccgccttgatgcggagggcgctgcagcgatggcggcagcggtcgccgctggcgcacaggcggctggcggaattgggatgtctggcgcaggcatgcgtgcaggggcgcaggtggggaccaccgcggtggccttgtgtgcgggtgcgcagcgcctttccttcaaccctccgcggcaccagtcagctatgggctactcggcatcgcaagggccagccgccaccggcacagccgcggccgtcaaacgggctatcttgtacggcggtggcactggcgctgccggcacagcagccgctgcggccgctgctatcaccgctgccaggtccgccgctggcttctccgacctctggccggcggctgcaggtcccagcagtgacgggagcctgtcctcagcccccatgagctctcagcctccggccctgctgaacgccgtgggttcctttggccgctcgcgactgggccccgggcccgccggcagcggccgcagcttcttgggcagtcaccccggcacgttcatgcccgccgccggccgatccaccagcagcggtggcgtgacgccggcttacgccgccgcggcggcggcggccgccgccgcctcctattctgtggaccaggcaggtacggtgggcccggcactgtcgccgctcttcaccattacggatgaggcggttgtcgagtacggctcagatgacgtacggcttgacggcggctcgacacgcgccgccacactcgacggcaacctccacggcaccggcaacgcgggcagtcatgcgccgagcgccgtcagcgcaagcacccgacgcagcgtcggcagcttcgcgctgctgtcggagcaccgtggcgctggcgggggcagcggcacagcaggcagttgcgcggtgctgtcgccgcctgcggtggggcggcgggcccgcggcggcggcggcggaggccgcggcagagctgcgttgctgcattcctcagcggaggagatggagggactggtgctggtgggcggtgtggagggtgacgagggtgacgatgacgaagacgcggacgcggacggtactcgtcgcgccaacagccgaaacgcacagcggccgcagcaggcacaacagggcgcggcggcggctgcggcgggcagctgcggccggcatggcagcaacaccggcagcggcgcgcttcgggacggtgcgaacggctctgggggcagctcggaaccggcggaggccaccctggcagggagcgctggcgagttcgaggagccggtcacgccgcggtctgcctacgatgcctctgctggcgccatggagtcggcgtcggtgcctatcacgcccatcccgcattccggcctgcggccccgcgctggcccttccgaggctccccagcagctgactgccgccgccgccgcctcggcttggcccccaggcgacgccgcggaggcctcgggagctgtgcaagccgaagacgctgctggcgacgggtgtgtgcgcccgaacctgctgttcccatggaccctccctccccaaccctccgacactgctacctccgcaaatgccgctgtcgccagtcccgcagccgccgtccccaaaccggtaaacacagtcgcagccgccgcggctgcggccgccttgaggggcaacagcggcgaggcgtcgctgggcgtgtcgccggcggcgccgcccgcccttgcgctggacaccctcctcagcgaggattcgctgggggcgctggggcgctttgcaaccggtgtgctttcccctcgggagctgccgtcgctgcagcacacaccggcggaggcgctggagccgccacagcagcagccgggtgcgtcgccatccatgcctgcgcctgcggcggcggcagtggcgaggatgggcagagccacgagtgacggccagcaggtgttgcagcaggtgccgagcggcggcgtgcctcgcactagccgcaccagcaccgccgcctccatcatgcgcgggcggccgtcgctgcagctgagtagctcctaccaccagcatggctcccccagcattgccttgcagacaagatctacgctgcctccatgccaacagcctgacccgcagcaggctttggaccagcagcagcagcagcaacagcagctggtgcagctgcagtccacgccactgcacaagctgggaggcattgctggcagtgctggcagcggcatcggtcgtgtgcgtggcgcggggctgaagcgcaacacaacacgcgaccgagtgcaaatgctcttcaccaacatccgacatcaggagcagcagctgctgcaaggggcaccgggccacggccccgcgcacgtgctctctccgcttggcatttccgcggcgttttcgtcggtcgtggcggacgcaacagttgggactgccgatggccgcagcagcgccgcacagcagccctggtcccccggccgcggcagccacgcggccacgagcatgggcattattgcaggcgagggccgcgtcacgtccttcaggcacagctgcggcggcatgatggggtacctacaagccggcggcctgccgcagcagcttgctgttggtgccggcggcgttggcggtggctgccgtagcatgaccaggtcgggtgcgggcgtggagggtgccgtggcggaagccgcggccgcccaagcggccttgggagctgcgccggcggctgagttttcggtgcccggtgctgcggagctgatgctggcggccggcggcggcgcgggcggcgcaatggacgtgagcggcgcgctgcctaccgtacacagcatcaccagcaacggtagcggccggaagtggcacaccgcggggaccgcagcaagccttgctagtcccgaggggccggtcgcgaatgttgcaagcgtcgccagtgtggcccacgcgccgttcgcggccccgccagcagccggaacggctcggccgtcgttctcaaagcacgccgcggcccccgcagctgcggcgcccgccgcgccgcgccggcagcgctggcaccggatgcatgcggtgctgtgcgacaccgggcagcacgagcgcctgcaccgcacggcacctggccagcagcaggcgcccggcgacgaggcggcgcaagctgtggagcagcaagcggagaaggcggctggcgcgggcaccgtcatgttcgtcacgatcacgcagatcgacgtgacggagcaggtggaggcgcaggcgcagctggccaagctgttggagcaggagcacaaggtgcgagccgcctgccgtgtgctgtgtgtggcagctggcctgtctgctatgcagcaggacggcccacacattactttgccgcgtccacctgacacacgttacgctgcccatcagcactcgtatgtgtgaacctatgcatcctgcattcctgatgcatcctgtgaactacatcaattgcaccaatcacaggtgctggagggcatctacccgcgccatgtgatcgagtactacagcgccggcggcggcaagctgattggctctggcgcggcggcctcgggccctcaaggcggcggtgccaacgtggagcgcatggcctcgctggccacgtggcacgagggcgtcaccatcctgtttgcggacattgtcggtgggtgaagtcacggcggttggaaggtagagcgccatacgtcagagcgcgggtttgctggactgtgcttggtgcggcacacggcgttgttgggcggtgctctgccctgtgtacgctcaacagtttgacaggcattccatgctgactgttgcctcgactgttgcctgcaggcttcacggccatgtgccaccatccgaccaccacgcctctgacggtcatggccttcctgaaccagctgtacaggtgggtggggtggcgggtcatatgtatatatgtgagtcgtacgcagtggcgccagttggttgggcgggatcacgggaaggaaatgatgatgtagcccagggccagtgttgcgttttgctgttggacttcctgtgcgaagccacgctggcagccatttgatgtcggtgctgattttttcttgtgtgctccgcagccgtttcgacgcgatgattgacatctacaaggtgtacaaggtggagaccattggtgactgctacatggtggcgggcgggctcgtcgcttacgatgacgacggctacaagtccgtcatctcgggtggcgaggacccgctgcatgccgtgcgcgtgatggagtttgcaaaggccatgatgcgtgccgcaagggatgtgcggatgccccataccggtgagccggtgcagatgcgcattggcctgcacagcggccccgtgaccagcggcgtcgtgggcgaccgcatgccccgcttctgcctgttcggcgacaccgtcaacaccgcgagccgcatggagtccacgtgccgcccaggcagcatccacgtctctgcgcccacccaggcgcggctgccgaacgagccgtggcgcgaccgcggcatgacggaggtgaagggcaaggggcagctgcagacatacgagtgggccggggacgtggatgcgccctatgacggcaaccagctgcagcgtgtgattggattgtatctgtaa

SEQ ID NO: 79 - DNA, 4028 bp, Chlamydomonas reinhardtii
atgacgattgaggttggcgactggctctccaagccctctaccggcgtgctaccgccttgtggcgtgttcgtcgagggcggtgagaagccgatcccggtgccgctcaagcggcgcgatgtctcagcgaccgtctacgccgctgcttccttttccgataccaaggagaccctgagctatgtgagcgacgtggagtgctcggcagtcttccgtttccccttgccgccgcgagcggccgtgtacaggtgcgtgccgcgtcagtgcagcaggccccgtatgggcccctcattgagccagcttgcattcccagtggcatggggcacatttgtttccacctttcctcctatgtacgtttatctcccgcgtaagtcatcgcttgcaacttatctaaacctgtccactgcctgccctccacacacaggttccgcgccgtgtttggagaccgcgaggtcgtgaccaaggtcaagccccgcgccgcggctcgtgaggaattcgacctggccgtgtcgcagggccactcggccgtgcacatgtcccagcacgaggcgggtgcgtccgtttttgaggtgtcgcttggcaacctggaggcgcacaccgaggtgacggtggagttcagctacctccggctgcttgacgcgttcggcggcacgctggagtggagccacaccgccacgtgggtgccgccgtacgtgggctcagcaggcgacgtggcaaccggcgtggacaaggtggcggcggcgctgcccacctttgcgcccaaggtgacctacgtcctctcctacgaggtcacggtgcgggcggaggcgggcacggtgcgtgccattgagtcgcccgagcctgtgaccgtggagcgcccagctgcggctgccgaggccgcggcaggtgctggtgcggaggaggtgtggcgcgtgcgtctgtcggagcaggtcgccgacccctccaaggacctctcgctggcgattgagctggatcccaaggccgcgcgccgcagcggcctgcgtgtgcagcgcacgcccgcctcccgcggcggcgagcagcgcactgttgcgctggccacgtttgtgccgccgctgcccagcccgcccgccgccggcgccgacggcaagcagcagctgcgcaaggagatctggtttgtggtggactgctcgggatccatggacggctctcccatcaaccaggcccgcgaggtgagtttagttcctagctgcttgcctggcattgcgtgtctgcggccacatgtgtgtgtgtgtgctttgcaccatgtcaccattgtcgtcgtgctttgtcactgtagcgccactctgctcgcccacagcccacacgccacagcccacagccggcgcatcaccattcttttcggctgcctttcccgctcctgctccccacaggccgcgctgttcttcgttcgtgacctgcccgtggacagcggcgtgcgcttcaacatgaccgtgtttggatccagccacaactcgctgtacagcaactgcaagccgtacgacagcaagaccgagaaggaggcggttgcctggatccagagcaaggtgcacgccaacctgggcggcaccgagattctgggcaccatgcagcacatctacaacaggtgagggcaaaggccgcgattatgttaatcttttgggtcgtcgcagccagtattgctgcatgggaagtggctgcaaggccagctgggttgtgcagcacagccgcatggcagcacagcagcttttctcgggctgccaggcctgcgcatatccgattctccagctcccgactgcattctccgcttccctctcaaacgccgctgccccttcttacttccccatccccgcagccccatcgcggccggctacacgcgtgagatcatcttcctcaccgacggcggcatcagcggccacgaggagcaggccgtgtacgacctggtgaaccccaaggccaaggcccccgtgcccgccgcagcccgcacccacgtcctgagcctgggcatcggccacggcgtgcaccgctctctgctggacggcatgtcgactcgctccgacggtgcggtcgtgtacgtggtggacgatgaggcgattgcggccaagaccgcattcctcaagaaggctgccacagccgctggcgccgccctgcgcccgcggctggtggcgcgcaatgcgctggtgcggcccgcgccgcacgtgctgcctcagcgcgtgtttgccggcgagcccctgcacgtgctgatggaggtggttagctctgagcctgacgcggcgctggagctgaccgcggactgggccgagccggagtcagctgccggcgcggcgccgctgactctgtcgctgccgctgggccctgcgctggcgtctgcggaggagggcgaggcgcttcctgtgctgcacgccatggcctacatcggcagcctcatggtgagtgggattgggcattggagcgtttggtttcggtaacttgggccgcactttgaccttactgacctgctttctacaacagtttgcttacaactgtatgcccctctgctgcccttaaacccaacaggccggcactagcccgctgcacgtgcggtctgacggcacgaccctggccgccccgccctctgctgacacggtcaaggaggcggtggtgcggctggcggtggccgagcacctggtcacgccgcacaccagcgccgtgggcgtgtcgctgcgccgcgaccccgctgcccccgaggccgctgccaacgtcgtggaggtgccgctgcagctaccacacggccgcaagctgtggggcaccgcctccggcgctgggcccatgccgccgcccatggctgtctgctttgccgcgccgcccatggcgcagcgtggaggcaggatggcatgcatgagcgcgtcggcgatggcgtgtgcgccgatgatggcgtgctcggcggcgccggcggcgccgccctgccccgtgccgcaaatggcgtcgccacagatgatgtggtgcggcactgcgccgggcggtggcggcggccgcggctctgcggctccggctgcgaccaaccaggcgtttgcgtctgcggatctgagcctacgtggcgagaagattggtgagttttcgacagcgatccaatgccgtagcctgctgcgccggccttagcatgcaaatgtgcatctgttgctaggtgtgttcgtatgggggttgttcatgtgtcctataccatttttggtgctgacattcgtgctgctgcctcgccttgtaaccttccacttgcagaggcgctgtccgacttgagctgcggcgtgcagcaggaggcccagtgcttcacgaagaaggcgctgaagaagaagtctgccgccgccagcctgggcgacgccgtcggcggcgccatgggctcgctctttggcggcctgttcggcagcggcagccgcggcgcctccgccgtgtgcgccaagccggcgcagcaggcgctgcagggccctggcagcgcaggcggcagctgtgtcgctgccgagttcgccgccccttgcggtgctgcggcgccggaggcggagcaggaggagtcgtgctgcgacgacggcgcggatgagatggaggccggcgactgcgacgctggctttagcgtgccggcgatgaaggagtcagtggcgcggcgctcgcgctcctgctccgcgtcgccgccggccgctgccgcggcgccggcggagcgccagctgcgtggctccgagctcctggctttcctgaacctcaagcgcaccacgcagggctactgggccgccggccccgagctggcggcggcgctgggcgtgccggttgtggacctgacatccgctgcgggtgctgccggcagcggcggcagcaccgcagcagtgctgcgccccgccggtctgaccgacgacgcctgggcgactgtggtcgtgctggctgtgctgcggcgctgcctggcggctcagcgggaggtgtgggcggacatggaggccaaggcgctggcatggctggcggcggcatggccggagggcggccgcagcgtgggaagcaccgtcatggctctggcaaaggcgctgacggtggaggcttga

SEQ ID NO: 80 - DNA, 834 bp, Chlamydomonas reinhardtii
atggcggaggctaactcgcgcgagctcgcgctttacagcgccaagattgctgagcagtctgagcgttaccaggacatggttgaggagatgaagaaggttgctgtgctggctaatgagcaggagctgtcggtggaggagcgcaacctgctctcggtctcctacaagaaccttgtgggctcccgccgcgctagctggcgcattctgcagagcattgagcagtcggagcaagctaagggcaacgagaagcgcgtgggcatgatcaagaggtaccgcgcggtggtggagggcgagctcgacaaaatctgccatgagatcctggacctgctcgacaagtacctggtgcccagcgcctctaccaccgaggccgctgtcttctacctgaagatgaaggccgattaccaccgctacctgtctgagtacaagacggacgaggccaaagcggcggccgcggagttgacgctggccgcctacaaggtcgcccaggagaaggccgacgagctgcccacgaccaaccccatcaggtacacaaggtttggggccggagcgcgcgcctggagcggcatgcatgcaagtttctgaccttgtttcggtgccgaatgtcgcgaatgcaggctgggtctggcgctcaacttctcggtcttctactacgaggtgatgaaccagcccgcgctggcctgctcgctggcgaagaaggccttcgatgaggctatctctgacctggactcgctcggcgaggattcctacaaggacagcgcgctcattatgcagctgctgcgggacaacctcaccctgtggacgtcagaaatgcaggacgacgacaagaatcgggcatga

SEQ ID NO: 81 - DNA, 8116 bp, Chlamydomonas reinhardtii
atgccttcggccgctaccaagaagaaggagctggagaagaagaagagcggcaagctttcgaagtcgcaggtgcgaccacaatgggcttgtttgtgcgtggaggaagagctcgggaagggcgctcagtcagggcggccgcccaggtccaacggcgcttcgccgtcagggcatgtcgtggtgttggcgttcgcgcagattgaatctatgctaaatttcgactagattggcctatgctctggcgagccgggccgtctctgacggggcgatgcctttggcggggtttgatggtcagccccctcaacaactcactgactcaagtgctctggggacgcacaagtgcttcaattaggtatcgtatactagattagctggaccgccaggctcgcccaggtggcagagcgcttttcagccgcgggtggcagcgctaaggccatgagcgcttttaaggcacctgcagcgccggcagcgagctgaatcgcgcacctcgcctttcgacctcggccaatcattactactcgaagaaacctacgcctcttacgccgacaccttgcggacggcccagctggccgttgtggcgccattgcgcggccggtctcccacgcgtttcacccccaaggctggcgcctccctcctccgcttctcgcagcccccgtccagagtcaggcagatcagttcaacccatgcagctctaagatccctcccaccacctatcctcgcgcaccgcccttcgtcttcacacgcgcctaacccgcagccccctccctccctcccaaccctccctcttacaaactcagagcacggcctcgatgccgcatgccgactccactgcctctctggcgtccaagggcggccccgtcgaggatgacgccttcaggtaagagctccgagctccagctttttattgccaccgccgccgtcctgtcttggatgaggcaacccccgtgatgtttgccttgctttcggagttggcttgtgacgacccattccgcgctacccgcgcccacacacgcccccgccctgcgttcccctgcctccctcgacagctcccgcaccgtgaccggcgtgctgagctcgcggcccaccgcacgcgacatcaagatcgacggcttcagcatgggcctcaacggctgcgagctgatccaggtgtgtgtacgtgcgtgtgtgtgttcttgggggtgggggtaaactctgaaccaattccgtaagggaacagtcgcgctgcacggagaagctgcagcggcatgtgcgtgtgtggggattcgagactgtgcagtgcagctgttcaggggcggggcggcttgtgtagctaggagcagcccgggtgcgggactgcggcacatgtgttgcggctgttagcgccgcggactccatgcggtctttgtgtactgtatgcattgactgcttcctgatggccatgctgtgggtcaactcactggcacaccgcacgcgcaccgcacggcaccacacctctgctgcactcacaccacaccacttcattcgccgccaccacctaacactcacccgccctgccctgcatcacaccacaccacacacaaacatgcaggactgctccatcgagctgaccatcggccgccgctacggtctgattggccagaacggttccggcaagtccaacttcctcaagtgcatcgccaagcgcgaggtgagagattggaactggcgaggagagagccgtcgggcgccgttacgggccgtgctgggctgtgctggggcggggacgcagagcaacgctcggcagccaggcccttgacacgttgatcccagcccacccatacccaaatccacccaaccgttttcctccccaaccgccccagcctcttcttgggccaaccttgcgtgtaacccgtcacctctccccgctctcaccccaccctgccccgtgagatgctctaccgtccatggctttcttcaccggtcatgaatgtaacccgatcccatccctttcacccctcactcccctcccctccccgcccccccaggtgcccatccccgaccacctggacatctaccacctggaccaggaggccgagccctcggagcgcaccgcactgcaggccgtcatcgaccacatccaggtgaggggggacgagggagagggaagcgagagggagggggagaagagagggaagagagtgaggggaagagagtgagggggagagggaagggagataagaggggagagacaagggagagagagagagagttgtgtgtgtatgggtgtttgggtgcgattgttttgggtgtgggggcgtgtcctaccgggtccgcggagggggggggggcgggaggtgtacgcatgtgccggacacgccggctagcagcagccgacacggagcctagaccgcgacagacacgcacgctggagcgcgaggcccaacgcgtcccatgtgcgccgcgcgtagccaaatgtgtatgcatgtgttgtgaacgtgcctcgcgtgtgtataaccaagcgtgtgtgtgctatgtgtgaatatgcctcgcttgttgtgcggcaggctgagctggagcggctgcacgccctggaggaggagattatgtccactaccggccccgaggacgagcgcctggaggtgagggggaggcagggagggggggagggagggagggagggagggagggagatgggtggggcctaggaggagagaagaggagaggagcggagggctgcgagaggttgggcccgtgggaacagggctggtggcagggccgggggcggcacagactggcatgggcgggaggggtggtgcttggatgggttcagaggggcaggagggcttggggagaaggttggcgtggcacaggagagagggccgggggggggggcacaggaggatggaaagggggagggcgctgcgggggaggctgcgggggaggcagggctggtggaaggcacacaaggaggtgtcagatgcatgcgggtggtgaggatgcggggcaggacagggcaagtgcggattcgggaggcaggcaggcgtgggcgcggttgtgttgtgtatgccggttcgagagggtagacaacaagcaatacttacatgtgcacacgcatgcatgcatttgcacacgcatgagtgcattgccgattgatgaccaaatccattagatgacgaatcggagcgggatagccgttgaaagcgccgcacaacttgacgacaaaacgaggcatttgtctgacggcacgaccagaaactcaatgaaggtctgcacggtgggcgcatacacatgcatttgcacacgcatgagtgcattgccgactgatgaccaaatccattagatgacgaatcggagcgggatagccgttgaaagcgccgcacaacttgacgacaaaacgaggcatttgtctgacggcacgaccagaaactcaatgaacgcttgcacggtgggcgcatacacgtgcatataccgtactctcgccgattgatgatcaaatccattagatgacgaatcggagcgggatagccgttgaaagcgccgcacaacttgacgacaaaacgaggcatttgtctgacggcagagagtggggtccagaactccagatcaaaagcttgcacggggcacggcacaagccaggcgggcagaatgggggtggggctgccgccgggcagttggggccaggcggcgagggcctgtgtgtatgtgtgcatgggctgcaggcacgatgcgtgtcaacgccgtcaactcggccggccacacgtagccatgcacacacacacacacacacacacacacacacacacacacacacacacacacacacacactcactcactcactcactctgcaccaccgcaatccgtcctcgtcaacccaacaccagagcgcctatttttcaccactctcctcacccaccaccgccaccaccacaccgccaccacaccgccaccaccacccacgcccacgcacaggccatctacgaccgcatcgacgagctggaccccgccacctttgagagccgcgccgccgagctgctgcacggcctgggcttcagccccgccttccagcagcgcctgaccaaggacctgtcgggtgagggcggagggcagggcggaaggagatggggtggaggggttggggcggagggtttgggagggggtttggagggagggagggggaggagaggggctggagagggcgggtggagggagggcgcagcgctggtccggttggagtatgctcctccaccgatcggtcgtactattgccgcaccttgctctgccgccagcaccttgccccgagtccggccccacgctcccacgaacacgctcccacgaacatgctcccacgaacacgctcccacgaacacgctccttgtgctaattttaacacaggtggctggcgtatgcgtgtggcgctggcccgcgccctgttcgctgcccccacgctgctgctgctggacgagcccaccaaccatctggacctggaggcgtgcgtgtggctggaggagtacctgaagaactacaacaagtgcctggtcgtcatctcgcactcgcaggtgggctggcggctgcagctggcagtgtgcgcttgggagcggctgggggccgcgtgcgggtgggggctgtgtgcggcttggggctgaggttttgtgtgtggcaggggtagagggagggaggcaggcaggcaggcaggcagatgggacaaggccgaacaccttgatccagggtaatggctgcctgcagtgatggctgccgaactacatgaagtctaatggcctaacctgacgcctgacgaccgcacctggcgcttgcgcacccactcacaggacttcctgaacggcgtgtgcacgcacattatctggctcacccacaacaagctgacgtactacaccggtgcgtactgtgggctggtatgaaagggggctggtttgcagggggtgggtttcatgaccgggggggcgttgggaaggcagggaggagctgtacggcagtactccgcgcgctgctgctgctgttgcgtgcgtgtgtgtgtgtgtgtgtgtgtgtgtgtgtgtgtgtgtgtgtgtgtgtgtgtgtgtgtgtgtgtgagtgagtgagtgtgtgtgagtgtgtgtgagtgtgtgtgtgtgtgggtgtgggtgtgggtgtgtgtgtgtgtgcgttagttttgcacccaacttttctgacacgctcctcctgaagacatgcaatcccttctcccatctcccataccctgcgccacacgccacaggtaactacgacacctttgtcaagacggtggctgagaacgaggtggtgcagatgaagaagtaccagaaggagcaggaggacatcaagcacattaaggagttcatcgccagctgcggtgagcaggacgcagcagcgagggagggaggaacagagggaggcgtggaggcgccacttcagcacttgaccgaccctacacgcacaggccgtgtcgggttactcccagttccatgcgacccaaatgcggcccgtcaggctggtgattcaagccgccaccttcccggcttgacctacccatcctccccgcctccccacctcgcccacccgccccgcctcgcccatccacccccacaggtacctacgccaacctggtgaagcaggccaagtccaagcagaagatcctggacaagatggaggaggccggactcaccaagcccgtgcagcgcgagcgcaccttccaggtgcgtgcgggggcgtgtgatacttctttcggtgctgattctgctgaattgcaacggcactgactcgcggggtttttgtgtatgtgcgttgcgtgcacattgacgccaacgggactcgaaaacgctttcggcatccatgactgacctgccctctccttccttccttcccatcttcctcgtcgcagttctcgttccccgagtgctccaagctgcctcccccggtgctgccgttcatcaacgtgtcgttcgcttacagtggcaagcccgaggagtacctgtacaaggtgaggggggtggagggcgggtggggggctgggtggggtggtggggagttgtgtatggggtgtggggcggtcacgtggcatgtgggggccgggggagatgtggacagagggtgtagtgtgtgtgtgtgtgtgtgccgtgcgcatggctacatgtccccgccgggtctcacccgccaccccacacaaatctcacgtgtttcttatgaacctcgcacgcgcgcgcccgcacaggacctggagttcggcattgactgcgactcgcgtgtggcgctggtgggacccaacggcgcgggtgaggcagggaggcagcagggggcaggcagggaggcaggcagggccgagcgcatgtgaggagttgcgggcaattgccaggcaggggcgcacgcatgtgagggattggagtgaggggagggcgggcaagggtagcggctgcctgtgtgggtctgtgggaagtgccgtagtagaagtaaggccggcggcggcgaccgctgcttggtgctgacgactccgcatcggcccccacccccacgaggtgctatactattgttcctggctacgccttcacaatttttaagtaatcatgagtgtgaaccccacctcccccacccccacgcctcaccccgtgcaggcaagtccacgctgctcaagctgatgaccggcgacctgacgccctcggtcggcaccgtgacgcgccacccccacctgtccatcggccgctaccaccagcactcggtgcgtgcctgacttcagaattgtgtgtgattggacagctgcatcacacacagcagccgtgctttgctgcctagctcttctgacaatgtgtgctttcagttttgcgtctcgtgccccgagggttgaacccgttagttgctgtggcccaactacaatacccggctgacgaatgtcgtgtgtgcactctcgcccctccccctccccctcccaaacgcccacaggtggaccagctggacgaggagaagactgtgctggagttcttcaagtccatgtaccccaacacacgtgagaagccatgcatcattttcattgcggtaccagctcgtttcgctcggtcgcggtgcaccgcacgcatgcactgccaagagatgtataccgacgttgtcacaaactttacaatgtccgagtccgcaacccaccaaaccttgactaatcatgattgtaaccaccaccaccgccaccactacccgctctgcttgcagccaccttcaagcgcgaggaggacgagtggcgtggctacgtgggccgcttcggcatcagcggccgcctgcagaccaccaagatcggcatgctgtcggagggccagaagtcgcgactggtgttcgccatgatgtgcatgaaggtgaggcgaaggggtgtggggtggatggagagtgagaaggacagggcgtgcagtgtgactgtttccggaatttaaaattgtccgtaacgcatgaaacgggcaggattggatgcccggacgcggcggctcacaggcttgggcgggagccgtctcgaggcgacccaccgcctgctcactttgtcccccgcctccccgctcccaactgctcctcttccccatctccttcctaccctccgccccgttcagaacaacaacctgctgctgctggacgagcccaccaaccatctggacattgaggccattgactcgctggccgacgccatcaagcgctacgacggaggaatggtgctggtcagtcacgacttccgcctcatcgaccaggtggccaaggagatctgggtgtgcgaggacaagaaggtgaggagggcggacgtggagggagggagggagggattgggagggctgggagggatgaggaagggctaggagggaggagggagggctaggagggagagggggctgaatgcacggagcacaagcccgaccgaggcgggggcggcagctgggggagggcggaggacgggcggcgagggaggggggcgcacacaccaacattgaggctccaacaccggccagttagaacaactctgacagggggctaccacattacaccttacacacgcaacaaaactaaatcgccccgctaccaatccttgcaacccccaggtgacgatgtggaagggcgacattcgcgactataaggcgctgctggccaagaagatgggcctcagcggcgtgcccggcaagaagtaa

SEQ ID NO: 82 - DNA, 4902 bp, Chlamydomonas reinhardtii
atgggtaagcgcacagccacagcgcatggtcagcgcgcgcgtgcgccggtcctcacgtgcgcttcgcttacttttgcgcaggcaatgagggcgaggttaaggtggcggtcaacgggacctctattgaggaggtcaactttgagaagattgatctgaaggaggcgctgtcaattctgaacgtaagtcggacgccgccgcgaagaaacgcatcgtcgcccagtcgctcttattaacgcgaacccatttatcgcgcagacgacgcctcatggactatcctccgcggaggcagacaagcgccttgcggagtatgggccgaaccgcctgccggagagcaagcgcattccgctcctggtgttcctcggctacatgtggaaccctctttcgtgggctatggaggccgcggccattatcgctattgctctgctggattacgctgatttcgccctcatcgtgggcctgctgttcctcaacgccgtgatcagctacgtcgaggagtcgagtgcggacaatgcaatcaaggtaagcttgtgtgctgcagtccttgtccagcgaaagacgtgtaacctcactgcaccgcgtggtgcatcaggctgttaacgttggtggctattacccccgcgcaggcgctggcgggagcactggcacccaagtgcaaagtcattcgagacggcacgctacaaaccatggaggcggtcaaccttgtccccggcgacgttgtggtcatgaagtttggtgacatcgtggccgctgacgtgaagctcttctccgacgacccgcagcatccgttcgattcacactctgaggaggtgcccatgcaggtgcgcatgtgcagcaaccattcgtgtcgccagcacagttcgtatagcccgtacctcgctcaacgccatcccttcccgcttcccttcccgcttcccttcgtcatgtgttgttactcactcttggggcttgctttcaattcacagattgaccaggccgccctgaccggtgagtcgctgcccgccaagaagcacaccggtgacgtcgccttctctggctctgccatcaaggctggcgagcgccacgccgtcgtgtacgccaccggcatcaacaccttcttcggcaggtgcgcaacacctggaagcatggtccagctagccttctcaacccctccgtatcacagtttcctcaagccttctcgattgttcgcaccaataccctgaaacgaacgctaacacccgatccgctgccggctttctcacgtgcagggctgctgcgctgatcagcggcacgcacaacgtcgccaacctgcagatcatcatgaccaagatcggaggcgtgtgcctggtgaccatcggtgtctgggtggtgattgagctggccgtgcagttcggccactacggccacggctgcacttccggcgagggtgagtgcaacggatgcggtctggacgcgcaagttatgcctgtacttgcacggggttggccgcaattagagtagacgcacaggtaccaagcgacaagccctaggcaggctcattggcacgcttccagctcacggtctgacgtctcccgtatcttgccacctccgcccgcgccgcgcagagggctgccccaccctgaccaacatgctggtgatcctggtcggtggtatccccattgccatgcccaccgtgctgtccgtcaccctggctctgggcgctgccaagctggccaaggagggcgccattgtggcccgcatgagcgctgtggaggagatggccggtatggacattctgtgctcggacaagaccggtgagtggggccggcggagtgaaggcgggcgggctgggcggtgcggatggcaccgggctgggtggacctgggcaggagtaccgaggtaaggcaagtcaaaagtggtgggactgggcacaaagctggtatagcttagcttgcctgcgcgcgctcacccgcttctcccttgccaacactgccgcaccgttcaggcacccttacgctgaacaaactgtcgatcgacatgaacaccatctacaagtgcgagcccggtatcaccaacgacgacgtggccaagtacggcgcgctgtcggccgacgttgccggcgaggagcccatcgacatggtgctcttcaacaactacgccaacgccaaggacctggccgcccgttacaagaagatcaagtgggtgcccttcaaccccaccgacaagttcaccgccatcacgctcatggaccaggagaccggccgcgtcttccgcctgctcaagggctcgccccaggtgcgccggccgtggctttggggtcggtgtggaaatcaggacgctgtatggcgatgtcgcggcagggcaaggcgggcgtgtgagttgcagtccggcgataatgccggggctggtggtatgtagccccaaaactgctgtacctgaaagcgccagtttctcacgctctacgcctcgccctgccgcgccacacacaggtggttctgggcaaggcgtacaacaaggacactctggccgacaacgtgaacgccaagatggtggagttcgccaaccgcggcttccgctccctgggtgtggccatggccgagggcgatggcgctgacggcaagcacgagtggcacatgctggcgctgctgcccctgttcgacccgccccgccacgacaccaaggacaccatcgagtactgccacggccagggcattgaggtgaagatggtgactggcgaccacctgctgatcggcaaggagaccgccaagatgctgggcatgggcaccgtcatgtacccctcggaggtcctgatcaaggtgcgcgtttgctctggggaatgggagctcatgggagacggcgcggtcttgggaaagggtgcgggctagaaagcgttggaagcggcaaaagtcagggagttgaagggcagacaaccagcaagctcagtggggcaagggctgcagatgtatcgtatcagtacaggagtctgaccgttcaggctgcgcgtcttgttcgctcgctgcaggccaagaacggcgacaagggcgccctgggcgacttccgcgacgtgacccacatggtggagtcgtgcaacggctttgctgaggtgttccccgagcacaagtacgagatcgtggccatcctgcaggtgtggaaggctcgcaagagggtggggggaggcgaggcgaggcgaactgggcgcgggggtatggcgaagccctgtggaggcgggtgaaggcgaggcaaagggaaacggaccgtaaagggggcaagagcaccaacgggttcggcaaatggtgaaggaaggaatcggcgagtaggtcaataaggggcgccgggggagtggaagggctacagaccagagccgtcgcaggcggcaggatcagagtagggagctcaggcgcaggcggatctccgggcgtgtgctttctgggtcgtcgctctcggtcaggttctgacctgccatccttctcctcccgttgccaccaacaggaggccgaccacgtcgtgggcatgaccggcgacggtgtgaacgacgcgcctgcgctgaagaaggccgatgtgggtatcgctgtggccggcgccactgatgccgcccgcggtgccgccgacatcgtgctgaccgaggcgggcctgtccgccatcaagaccgccgtgctgggcgcgcgcaagatcttccagcgcatgaccacctactccaagtacacggtggccatgaccttccgtatctgcttcacctttggcctgctgaccgtcatctacgactggtacttccccaccattctgattgtgatcatggccgtgttcaacgacggcgccatgattgcgctggccaaggaccgcgtggagcccagccgccagcccaacgcctggaacctgaagaacatcttcctgatgggcattgtgtacggcctgtacctcaccctgtccacctgggcgctgtaccagaccgcctgcaagaccagcttcttcgaggaccacttccccatcttctcgctggacgaccgccacatcaccctgcagaactggtgcaccggctacatcaccaaccagctgaacctcaacccgaccgccagcatctgcaccatgcccacctacctggcgcagttcgacagccaggcggcttgcattgaggagatgggcggcgagcagatcatcaaccagtgcatggccgagcagcgctacatccgcggcgccatgctgcgctcgctgatctacaaccacgtctccatctccggccaggcgctggtgctggtggtgcgcaaccagggcttctccctcatggagcgcgccggcagcctgacctacatcgccttcgtgctggcccagatcggctccaccgtcatctcggtcttcggcttcggcggctacgtgccccctcgccaccgcttcaccgactgccagttctgcagctactctgactacacccccgtcaagttcttccccagcaaggaggtgcccatggccggcaccgagtcggtgtacacggcctccgtgctgggctgcctgggctacgtgctggtggcctggatctggacgggcatctggtacgtgctgctggaccccatcaagtgggcgctgtgctggatgctcaacgaggacggcttccgcgacatggccaccatgaagcacgagcgccgccaggagctgggccgcacctcgcagcagaaggccgccgacgtgggcgtgaccggcatgaccgtgcccaccgcctccaacccgctgggccgcgcctcgatccagaagcccgtcaccatggtgctggaccgcgcctcggccgccctggtgcccgtgcaccgcaccagcgacggcctggtgcgcgtgtcggccgaccccgccaaggcccgcgacctggcgcgccgcagccgcctgaacgagggcatgcagcgcaccagcggcggcgcgcacgctgccggccacaccggccagaaggagatcacgcgcgcttaa

SEQ ID NO: 83 - DNA, 5276 bp, Chlamydomonas reinhardtii
  misc_feature (1573)..(1672): n is a, c, g, or t
atgaaggatgttgccaacaaggaccatatcagcagggtcgaggtgaccatgaaaaaccatatcagcaggttcgaggagaccatgaaggaccatatcagcagggtcgaggcgaccatggagggccatatcagcagggtcgaggagaccatgaagacgggctttgtggagcagcagaagttcttcgtgctgctggcgctcgcgtttccggtgctggttgcaatcttcctggccctgatatttggggctatcacgcagtttcccgtggaccccagcagcgtagttggactgctgatttccaagaatgcatagttccggtgagattggagaggggggagggagggagggagaggaggcaggggagggagggaggggagggagggatggtgagggagggggcatgggaggggacatagccgcggtggcaaaggcgtggcggcttgcaccgactgaactgccgctaccgtatcctgggctccttgtgccgcggccccacaaaccctgctgctgccgatgctgtccgttcacaaccaagaatacttagctccggtgagtttggagatggggtgcgtgggccgagactccggtggagggcagggcccatgaaatgggtggggtttgtgtgggggtgtgggtttgtgtgtgggtgtgggtgtggggagttgtgggtttgtgtgtggggggtggggggtgtggggtggggggggtgggggggtgttgtatataccagcccaaactaaacccaaaccaacgaaaactggagtgcaggcagaggcgttagttgcgagcgataatacttatgggttgtgggccgaggcgtcgcggagcagcagggcgagcggcgccggcgataaatgtcgccgcccgggctcggtgacgcgcacaacagcacaagacaggcacgcggacgcgacaagcaaaacccacgacttacctggcgaccaggaaagcagccccgacgccaggcagggagcttcgggccaggagcacgacatgtgggaaaagggcaaggcaaaaatcggaagggcagggcacagtgaaagggccgaggcgtgtcggcagtaggataaagaagggataacaaagacaaggctacacacaagcccaggcggcgaaagaggcagagagggtgtgaggcacgggttaagaggtagatgtgggtggcatggggaccggtcaggggagagatgaaggggtgctgggcagtgggggtggatgggtgtggggaaagctggtagaatggggtgacagccatggggaactgcctgatgtagttgctatggactgcgggcatggctgcagtggcacctgcttggggctaatgcgcacacctcgagaccaattctgggtgtaacggaaacacccgacgcccatgacagcaccgccatcaacacccgctgacccgcacccccacctacgccttcacttcttaaagaatcatgaatgtaacccccactcccactacctgcgcacctgcatacacaggtcatggctcagatcatgggcgctgtagcggcgctgatgcgggtgcagttcgtgagcggcacacacgccatcgcctcggcgctgtactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtggcgccagctggtggcgccagctgccagcggcgcgtcccgtcattacagcccaccctttatcccgcataccgatcccgtgcccagctgccagcggcgcgtcccgtcattacagcccaccctttatcctcggcctcgctgcacggcctcgagggcgagggccggtgtgggttgccaccagtgcttcatgggcacgcagcgttgcatagggggtcgcgcattagcgctgtgacgttgcggggggtctgcaaggctgatagctgataactggatggggcatgccgcggcccatgtcccagcttgaccattcggagcttaaacagcgctggcaccgtgcatgaatgggccttgcatgcgcatgttcgtggacctgagggatggcatggacataagggatgtgggcggccctggtttttgacacactggagtcaggaggcacatgagaaatgaataaagacaagtgcaacccggtctcaccggggcgtgcccattcacgcggcaccgtccaaagcccaaaccatcctaaatgcctttacagggcatactgtatgttatgaataagtggaagtggcgacctgcctgctcgccgagggcagtgggcggaattttggactaggaatctgagacgacaggcgtgtgtggggggggagggggagatcggtaaggtcagaatctagtcggacttttcccccgaccagttttgtggggttgaagtgactgcaactttggacggtgcgcgcagcgcaggtgagaccgggttggacgagatcatctagacaagacgggtcatctacgctacgtagacgccgcggcgggcctgaaggcatcttcatggtaggggcattggcagaattcacatagttatcagtactaccatactattgaatggagggcagaggacggcgccctgtaagtgcagtaggttgatcggtcgatccatgcacgcgcccggaagcgcgacagtaccagcaccagtggaggcgcgggccgccatagcaaccgccacgtacaccacggtcgcttgatcatctccaagcgcacgggtcagcgtcgtggccgggtccgggtcggggtcagggtccagatcgtcagaggagctgaagttagaagtgaggtgatagtagaattgaagcgcgttggttgtcggttacagtaggcttatgcaaatgcatgttacccggcgtgcctcgacgtgccccgcgcccgtgcccacagatttggcctccgtacaccggcggccgcgacgcgggctgcggccgcgttgtgtctcctgccctgcgtacgcagcagctaggcggcagcgctggtggggcactgtggcacggacgccgctggtcacgccgcatgtgcagggcggctagcgacgtgagctgggcgtatgctgcagccggggacgacgaggacgacgcggaggcgggcgaggtaggaagccgactgagggaggcgcgttgcgatcaggggactagggttttgtgcgatttggaccgattgcttgacggaggaactgcaaggcggcaacaggccagaacccgaataattgaagggccagactagcactgatcgccgcgtgaggcgcttttttgggttcggcatgtaacggtgacgcagcgaatggagctctcggacggcttaaaacgcactgccgatagcaaggcggaggagcgatggcactcaacgtataatatcatcgattcactggcgagatgcgcgagcctcggagcgcaagcaagcaaatggtgcggattcgcgggaacggaatggcgactcccgcggacgcccggaactctaaataagacggctgagtccttgacgcgcgtgatactatcggcttcactctaatacgtttgtccgtctgtccgccgctgacgtgtcacccactcaccccggaccttcctgcggcacccccgcacaggctcccgcccgcctgcactctcgcctctccggcaaaacccccgctggcgccgaccgacgctgcgctgccaccgccgtcgcccgcacccgcacccgcggccctccaccccaccgacccgcgcaacaagaccgagcgcttccgcctggtgctgcaacagcccgccgccttcatgacgccggagcttcgggaccagctgcggcagcgcgtgctcgtcatcgtgcgcggctacctgtcctcgctgtaccgggcctgcctgggcgcctacctggaccaccaggtgagcgccctcactgtcataagctgctgcgggagtcacaaggagtcaggggcctgagagactctgacctgcacagctgcactgcagtcgtgcagtctgcaccaccttgcccgccgtcgttatctccggctatctaggccgcccctagacacggtagcccccagcatgcgctgtaatgcatggactgccgtactgcggtagcgctgccgcctcttccccactccttacttgccacgacccgcagcgtgccgccacccgcactactcccgccgcaggccgccgccgcccaggcgctgggcatgcgagtgctggtcggcaacatctgctgctgcagcacctccgcccgcaacagcgcatcgctggcggcccagatcgccgcacacaccgccccacacgaccgagtcatcatcctggcacacagccacggcaccctggccgccctggacctgctgtgcaacccggcccacgccgccgtgtcgcaacgcgtggagtgcttcctcccccttaacggcgtgttcggcggcacgcccatggcagacctgtgcaccagctcgagcctggtgagtgcggtgctggaggcgacctggggccggctgctggcggtggtgggcggcggcgaggcgggcgtgctgcgcgacatgacggcggcggcgcgccgcgcatatcacgcgcaacacggcgatcgcatcgcggcggtgctgcggcgcgtggcggtggtggcgctggcgtcgcactaccgctggccccggtggccgccgccgcggctgctgcgggttgctgctgtggaggcggctgtgggtgtggccctgctgccgcagcgcatggtgatggacgcgatgggctgggcgcccaatgacggctgcgtgccgctggccagccaggtgcgtgcgggggcacatgcatgcgtgcatgcagctagcggcgtacacacacgatcaccggaagccttgctaccgacttctgcacgtgccacacgccacgcagtcacaacccatgggtggcgctttgccgtctgctctggtctgcttagcccgctgccttcactgctgcattacactgtcatcccaacatcgacttgcctgcccacacgtgcagctgctgccgggcgcggcctacgtggtgtgtgagggcctgcaccacgtgcacaccgtggacgacctgggtgcgctggacctccgggcgttcacacacacgctgctggtgctggcgtcggaggcgcggctggcgctgatgaaggagcagggagaggaggtacaggggcaggcggagcgggagcgggaggagaaggaggcggagggtggaggtggaggcaaaggtggtggtggaggtggaggggcggcggcggtgcaccggcatgaggaggaagtggcgcggcgcctgctagcgcccggtggcgccggaggtggagattaa

SEQ ID NO: 84 - DNA, 5004 bp, Chlamydomonas reinhardtii
  misc_feature (1)..(51): 5' UTR
  misc_feature (3648)..(5004): 3' UTR
gctgccgaggtgggtgacggcagggaaagggtgttcctttttatcccatccatgttcgagcccacagctgcgccatcgccgaagtcggcttcggccgcctccagcagccccgcagcttcctccagctcgtcctcctcctcgaccacctcccggccgcggccgaagaagaacaccgtgtcgggcagcaccaccaccggccggaccagcagcagcagcagcagcaacaccagcagcggcaatggcagcggcggcggcgggggcttcaacttcggggctgtgggcgccacagtgctgggcggcattggagccttcctggggctgcagcagttcggcaagacgtcggactcctccaaggctgcggctctggcccaggctgtggagcggctgggtgagaagctggaggacaaggagaaggagaaggaggaggtcaaggcggtgctgcagagccaggtggaggagctgaaggaggagaaggaggcggtgatgcaggcggccaagtcgcgcgaggacgagcttcaggcggtggcggtggagagccaggcggtggcgcagcagctggagagcgaggtggcggcggcgcgggcggccatccaggacaaggagcgcaagatgctggagctggagaagcagatcgccaagatgaagcagcagatctcaatcggcaaggaccagctgctggccacaaaggacatgaaggaggccactgcgctcatgacggacctggcgcccaaggaggtcatgctgcgggagctggaggcgcaggtggcgctgctgactgtggaggccaaggaggcgcgcatgctgctgggcgagcgcgaggccaaggtggcggcgctggaggggcaggtggcgtccatgcagtccattgtgcagtacagcaagcaggagctcagcctgcgcgcgcgggacgccgcggagctgacgcaggtgaagcaggagctgatgaccaaggagcagaaggtccgagagatgaagcagctgcttgcggagctgcagatgcagcagcagtccagccggctggagatggagtccatgcgcgaggagctggacagcgcccggtccattgccggcgagctggagaagcgcaacgcctcgctcatgcgcatgacgcagcagagcctgggccgcgagggcgacctcaagcaggcggtcaacagcaccaaggcccaggtggccaagctggagtcggcggtcaacaccgccagccagcagctgcagcagcgggcgcagcagctggcgtccgtcaaggcctcgctggacgagcagacggcggaggtggcggcgcggcaggaggcgctggaggcgcgcgaggcggcgctggcggcggcccggcagcaggcggaggagctggaggccaagaacacggtgctggtgcgcagccgcagtgtggagctgggcaagatgcaggacctcaagcaggcgctcaacgccacccgggcgcaggtgaccacgctggagaagcaggtgaaggaggccaacgtggcgctggccgtcaagtccgccaagctgcgcgagctggaggtgcaggttccggcgctgcagaaggagctggccaccggcaagcaggctctggaggcctcgcgcgccgagctgctggctgcccgcagcgccgcctccgacctggaggccaagaacacggcgctcatccggcaggccaccgccagcctgagccgcgagggcgacctcaagcaggcgctcaacatcagccgcgccgagtccgccaagctggacgacgagctgaagaaggccaaggccggcctggccgccgccagcacctcggcctcggaggccaaccagcgcctcaccgtggcggaggccaaggtgcgcgagacggagacgcagaaggcggcgctggtgcgcgacgcgcagatggccctgtcgcgcgccagcgacctgaagcaggcgctcaacgtgttcaaggagaagagcgccaagctggacggcgagctcaagagcgcgcgcacgcagctggccgccgccaccagccaggcccaggccgccaaccggcagtggcaggacgcggagaacgcgctgcgtgaggcggagcagcagcgcgagaagctggtgaagacggcgcaggtagcgatcaccaagtccacggacctcaagcaggcgctcaacgccaccaagcagcaggccaccaagctggagacggaggtcaagcaggtgcgcggccagctggaggcggtgggcggccgcgcggcggaggcggagaagaagctgaccagcaccagctcgcagctggaggcggcgcgggcggagcgcgagaagctggtcaaggaggcgtcttccgcaatcaccaaggccactgacctgcgccaggagctgaatgccacccgtcagagcgccaagcagctgaacacggagctgtcccgcgcgcgcgagcagcagcagcaggcggcgcaggcggcggccgccagcagccagcagctggcctccacgcgctccgagctgagcagcaccgcggaggcgctggcggcggagcaggcgcgcgtggagaagctgagcgagcagcgggcgctggcgctgcgggagagcaaccagatgaagacggcgctggagtccaccaagcgccaggcgacgcggctggaggcggaggtgaaggccacccgctcccagctcaaggcggcggagcaggaggcgcgcgaggcggaggagcagctgagcgcggcgcggcagacgctggcggtcacggagggcgcgctggccaccacaagcggccagctgagcgaggcggagaagcagaaggcggtgctcatgcgcgacatgcaggccagcctgggccggctgggcgacctgaagcagcagctcaacagcacgcggcagcaggcgggccagttcgaggaggccgccaagaagttccagggcgaggccgaggccgccacgggccgcctggcgcagcttcaggaccaggccgcagcagcagtcagccgctcgcaggcggccgagaccaagctggctgacctgagccaggcgctggcggaggcggaggccgtcaaggcctcgctgctgcgcgacagccagttggcgctgggcgcccgcggcgacctcaagcagtccctcaacatggtgcaggccaaggtgtcgcggctggaggcgcagatggcggcggccaagggcgaggccagcgccacctcgctggcggcgcgggaggcctcgcggcgggcgcagtcggcggaggcggcgctcaaggagagcgagagccggcgcgcggcggcggaggcggccgcgcgggcggcggagctgcagcgcgcgagcgcgatggcggtggcgcagggcgcgattgggcgcgagggcgacctgaagcaggcgctcaacaaggccaagcagtcgggctccaagctggaggatcaggtggccaaggcgcgtgacgccatgaaggcggcggaggagcggcgcgcggcggcggagaaggccatggtcaacatgcagggccagctgagcaacacggaggccaagttcacggaggcggcggcgcgcgtggcggaggcggagtcgctactgcaggcagccgaggacgcggagcgggcgacgtcgcccggccgggccggtcgcaacggcaccggcagcggcaacggcactgggagcggcgccagctacggcgtcagcggcagcagcgtccgcaacagcgttctcaagacgccctagaggggcggcggtggcagcacagcagcacacggcggcggcggcggcggggacggacagcaaagaatcggggaacgggataggacttgtctttgaagccgggtgggttgggttgggttgtgggacaggtaggaaaacagtagtcgccaggtcagcagacgggagcagcgctgctggtgtgttgagttcgggggaggggtcctgctgctcggaggttgcttagccatcaattttaccacgaatggcaacatcgcaccacctgctgacgccgggcttgcgccattcgttttacggcacccttgaaatagagcgggagcaggcgtagagagagagtgccgtgcacgtaccattcacttatgaagacggaacacgtgagagagatgtgtttgccggtgctcacggtaagctgttagtcattcccctgccaccatgagtatttccattacatcttggcagcagtgagcgatggagtatgcgtgtgtgattcgttgccgctacagccttcgcggcgtgagtttttttgttgcggaaggggagcgggctcgaccacgggcctctagcttatcccctgtgacgcccctgattgtgtagctgtttgaacaggcacgaattcacgcacgcataccagcaatcggcaccgccctctataccgggcgttcgctggtgaagtgtgttgttccccggacttaactgtggctaacttaactattcgggcggtagggagcacccaggttgtgcgtcgcatgaaagcgcctgcactggcggtctctatggcacagtgcctgctttatgccaggctgctgcagtcccctttgtgtgtggtggggcgtcatgagagctgccggcttgggtttgcattgtgtggctcgtgttgggggcaggcgaggctcgatgcgtggcacaggcaggccctcggcgcccgcaaggggcatgccatcccccgcacaagctagtgagctagtagaggatgtggtgggtatggaggttagcgtagccgtgtcacaggctgccgaagggcggcctgtgtgcgttgcaaaggcgggttgtagtactcggctgcaatgaagttgaggttggcgcgaccggacccgcattggatcactttcgcgcgcttcggaggaatcagaggtttgggccacggccgggccatagacagtttggcacagcgttattggagcttatgtgggaccgcacgtctgtgacgaattgaggcggacggcgtggctagagtgctcctttgagacgtagtctgtaacaaacacttggtttgtgtgcatgcggccccggccttgacggctgtgcaggctgctcgcagcaacacgtcggcgcccacatggcgggcctcgggcgatcgggcct

SEQ ID NO: 85 - DNA, 3597 bp, Chlamydomonas reinhardtii
atgttcgagcccacagctgcgccatcgccgaagtcggcttcggccgcctccagcagccccgcagcttcctccagctcgtcctcctcctcgaccacctcccggccgcggccgaagaagaacaccgtgtcgggcagcaccaccaccggccggaccagcagcagcagcagcagcaacaccagcagcggcaatggcagcggcggcggcgggggcttcaacttcggggctgtgggcgccacagtgctgggcggcattggagccttcctggggctgcagcagttcggcaagacgtcggactcctccaaggctgcggctctggcccaggctgtggagcggctgggtgagaagctggaggacaaggagaaggagaaggaggaggtcaaggcggtgctgcagagccaggtggaggagctgaaggaggagaaggaggcggtgatgcaggcggccaagtcgcgcgaggacgagcttcaggcggtggcggtggagagccaggcggtggcgcagcagctggagagcgaggtggcggcggcgcgggcggccatccaggacaaggagcgcaagatgctggagctggagaagcagatcgccaagatgaagcagcagatctcaatcggcaaggaccagctgctggccacaaaggacatgaaggaggccactgcgctcatgacggacctggcgcccaaggaggtcatgctgcgggagctggaggcgcaggtggcgctgctgactgtggaggccaaggaggcgcgcatgctgctgggcgagcgcgaggccaaggtggcggcgctggaggggcaggtggcgtccatgcagtccattgtgcagtacagcaagcaggagctcagcctgcgcgcgcgggacgccgcggagctgacgcaggtgaagcaggagctgatgaccaaggagcagaaggtccgagagatgaagcagctgcttgcggagctgcagatgcagcagcagtccagccggctggagatggagtccatgcgcgaggagctggacagcgcccggtccattgccggcgagctggagaagcgcaacgcctcgctcatgcgcatgacgcagcagagcctgggccgcgagggcgacctcaagcaggcggtcaacagcaccaaggcccaggtggccaagctggagtcggcggtcaacaccgccagccagcagctgcagcagcgggcgcagcagctggcgtccgtcaaggcctcgctggacgagcagacggcggaggtggcggcgcggcaggaggcgctggaggcgcgcgaggcggcgctggcggcggcccggcagcaggcggaggagctggaggccaagaacacggtgctggtgcgcagccgcagtgtggagctgggcaagatgcaggacctcaagcaggcgctcaacgccacccgggcgcaggtgaccacgctggagaagcaggtgaaggaggccaacgtggcgctggccgtcaagtccgccaagctgcgcgagctggaggtgcaggttccggcgctgcagaaggagctggccaccggcaagcaggctctggaggcctcgcgcgccgagctgctggctgcccgcagcgccgcctccgacctggaggccaagaacacggcgctcatccggcaggccaccgccagcctgagccgcgagggcgacctcaagcaggcgctcaacatcagccgcgccgagtccgccaagctggacgacgagctgaagaaggccaaggccggcctggccgccgccagcacctcggcctcggaggccaaccagcgcctcaccgtggcggaggccaaggtgcgcgagacggagacgcagaaggcggcgctggtgcgcgacgcgcagatggccctgtcgcgcgccagcgacctgaagcaggcgctcaacgtgttcaaggagaagagcgccaagctggacggcgagctcaagagcgcgcgcacgcagctggccgccgccaccagccaggcccaggccgccaaccggcagtggcaggacgcggagaacgcgctgcgtgaggcggagcagcagcgcgagaagctggtgaagacggcgcaggtagcgatcaccaagtccacggacctcaagcaggcgctcaacgccaccaagcagcaggccaccaagctggagacggaggtcaagcaggtgcgcggccagctggaggcggtgggcggccgcgcggcggaggcggagaagaagctgaccagcaccagctcgcagctggaggcggcgcgggcggagcgcgagaagctggtcaaggaggcgtcttccgcaatcaccaaggccactgacctgcgccaggagctgaatgccacccgtcagagcgccaagcagctgaacacggagctgtcccgcgcgcgcgagcagcagcagcaggcggcgcaggcggcggccgccagcagccagcagctggcctccacgcgctccgagctgagcagcaccgcggaggcgctggcggcggagcaggcgcgcgtggagaagctgagcgagcagcgggcgctggcgctgcgggagagcaaccagatgaagacggcgctggagtccaccaagcgccaggcgacgcggctggaggcggaggtgaaggccacccgctcccagctcaaggcggcggagcaggaggcgcgcgaggcggaggagcagctgagcgcggcgcggcagacgctggcggtcacggagggcgcgctggccaccacaagcggccagctgagcgaggcggagaagcagaaggcggtgctcatgcgcgacatgcaggccagcctgggccggctgggcgacctgaagcagcagctcaacagcacgcggcagcaggcgggccagttcgaggaggccgccaagaagttccagggcgaggccgaggccgccacgggccgcctggcgcagcttcaggaccaggccgcagcagcagtcagccgctcgcaggcggccgagaccaagctggctgacctgagccaggcgctggcggaggcggaggccgtcaaggcctcgctgctgcgcgacagccagttggcgctgggcgcccgcggcgacctcaagcagtccctcaacatggtgcaggccaaggtgtcgcggctggaggcgcagatggcggcggccaagggcgaggccagcgccacctcgctggcggcgcgggaggcctcgcggcgggcgcagtcggcggaggcggcgctcaaggagagcgagagccggcgcgcggcggcggaggcggccgcgcgggcggcggagctgcagcgcgcgagcgcgatggcggtggcgcagggcgcgattgggcgcgagggcgacctgaagcaggcgctcaacaaggccaagcagtcgggctccaagctggaggatcaggtggccaaggcgcgtgacgccatgaaggcggcggaggagcggcgcgcggcggcggagaaggccatggtcaacatgcagggccagctgagcaacacggaggccaagttcacggaggcggcggcgcgcgtggcggaggcggagtcgctactgcaggcagccgaggacgcggagcgggcgacgtcgcccggccgggccggtcgcaacggcaccggcagcggcaacggcactgggagcggcgccagctacggcgtcagcggcagcagcgtccgcaacagcgttctcaagacgccctag

SEQ ID NO: 86 - protein, 1198 aa, Chlamydomonas reinhardtii
MFEPTAAPSPKSASAASSSPAASSSSSSSSTTSRPRPKKNTVSGSTTTGRTSSSSSSNTSSGNGSGGGGGFNFGAVGATVLGGIGAFLGLQQFGKTSDSSKAAALAQAVERLGEKLEDKEKEKEEVKAVLQSQVEELKEEKEAVMQAAKSREDELQAVAVESQAVAQQLESEVAAARAAIQDKERKMLELEKQIAKMKQQISIGKDQLLATKDMKEATALMTDLAPKEVMLRELEAQVALLTVEAKEARMLLGEREAKVAALEGQVASMQSIVQYSKQELSLRARDAAELTQVKQELMTKEQKVREMKQLLAELQMQQQSSRLEMESMREELDSARSIAGELEKRNASLMRMTQQSLGREGDLKQAVNSTKAQVAKLESAVNTASQQLQQRAQQLASVKASLDEQTAEVAARQEALEAREAALAAARQQAEELEAKNTVLVRSRSVELGKMQDLKQALNATRAQVTTLEKQVKEANVALAVKSAKLRELEVQVPALQKELATGKQALEASRAELLAARSAASDLEAKNTALIRQATASLSREGDLKQALNISRAESAKLDDELKKAKAGLAAASTSASEANQRLTVAEAKVRETETQKAALVRDAQMALSRASDLKQALNVFKEKSAKLDGELKSARTQLAAATSQAQAANRQWQDAENALREAEQQREKLVKTAQVAITKSTDLKQALNATKQQATKLETEVKQVRGQLEAVGGRAAEAEKKLTSTSSQLEAARAEREKLVKEASSAITKATDLRQELNATRQSAKQLNTELSRAREQQQQAAQAAAASSQQLASTRSELSSTAEALAAEQARVEKLSEQRALALRESNQMKTALESTKRQATRLEAEVKATRSQLKAAEQEAREAEEQLSAARQTLAVTEGALATTSGQLSEAEKQKAVLMRDMQASLGRLGDLKQQLNSTRQQAGQFEEAAKKFQGEAEAATGRLAQLQDQAAAAVSRSQAAETKLADLSQALAEAEAVKASLLRDSQLALGARGDLKQSLNMVQAKVSRLEAQMAAAKGEASATSLAAREASRRAQSAEAALKESESRRAAAEAAARAAELQRASAMAVAQGAIGREGDLKQALNKAKQSGSKLEDQVAKARDAMKAAEERRAAAEKAMVNMQGQLSNTEAKFTEAAARVAEAESLLQAAEDAERATSPGRAGRNGTGSGNGTGSGASYGVSGSSVRNSVLKTP

SEQ ID NO: 87 - DNA, 336 bp, Chlamydomonas reinhardtii
ggtgttgggtcggtgtttttggtcttggttggggtgttggtggtgctggtggaacatgtcaacatgcccaggaaaccaaggcgcgctagcttcctgggcgcagtgttccagctgcagtacacctggtcccgctatttgaatctcgctgatcggcaccatgggggtggtggtgatcagcgctattcaggtagcgggaccaggtgtactgcagccggaacactgccaggaaggagggggaggctgggtgggagaagcggtgtggggcggattagccttggagaccgattgctttgggttagtttgggctggcatagtttgggctggcttagttacacc

SEQ ID NO: 88 - DNA, 34 bp, Artificial Sequence
  Primer 1
  misc_feature (5)..(10): AseI site
gactattaatggtgttgggtcggtgtttttggtc

SEQ ID NO: 89 - DNA, 33 bp, Artificial Sequence
  Primer 2
  misc_feature (5)..(10): BamHi site
gactggatccggtgtaactaagccagcccaaac

SEQ ID NO: 90 - DNA, 28 bp, Artificial Sequence
  Primer 3
  misc_feature (1)..(6): AseI and BglII site
agatctcagctggaacactgcgcccagg

SEQ ID NO: 91 - DNA, 42 bp, Artificial Sequence
  Primer 4
  misc_feature (16)..(21): BglII site
gcagtgttccagctgagatctagccggaacactgccaggaag

SEQ ID NO: 92 - DNA, 22 bp, Artificial Sequence
  PCR primer
gtaatacgactcactatagagt

SEQ ID NO: 93 - DNA, 19 bp, Artificial Sequence
  PCR primer
actatagagtacgcgtggt

SEQ ID NO: 94 - DNA, 20 bp, Artificial Sequence
  PCR primer
ctaatacgactcactatagg

SEQ ID NO: 95 - DNA, 20 bp, Artificial Sequence
  PCR primer
actatagggctcgagcggcc

SEQ ID NO: 96 - DNA, 27 bp, Artificial Sequence
  PCR pimer
gaccaacatcttcgtggacctggccgc

SEQ ID NO: 97 - DNA, 21 bp, Artificial Sequence
  PCR pimer
gaccaacatcttcgtggacct

SEQ ID NO: 98 - DNA, 27 bp, Artificial Sequence
  PCR primer
acttcgaggtgttcgaggagaccccgc

SEQ ID NO: 99 - DNA, 21 bp, Artificial Sequence
  PCR primer
ctggtgcaactgcatctcaac

SEQ ID NO: 100 - DNA, 22 bp, Artificial Sequence
  PCR primer
acttcgaggtgttcgaggagac

SEQ ID NO: 101 - DNA, 18 bp, Artificial Sequence
  PCR primer
ctcgccgaacagcttgat

SEQ ID NO: 102 - DNA, 19 bp, Artificial Sequence
  PCR primer
ggctcatcaccaggtaggg

SEQ ID NO: 103 - DNA, 27 bp, Artificial Sequence
  PCR primer
cgaatcaatacggtcgagaagtaacag

SEQ ID NO: 104 - DNA, 22 bp, Artificial Sequence
  PCR primer
cgaatcaatacggtcgagaagt

SEQ ID NO: 105 - DNA, 23 bp, Artificial Sequence
  PCR primer
aacagggattcttgtgtcatgtt

SEQ ID NO: 106 - DNA, 19 bp, Artificial Sequence
  PCR primer
ctgctcgaccctcgtacct

SEQ ID NO: 107 - DNA, 21 bp, Artificial Sequence
  PCR primer
gacttggaggatctggacgag

SEQ ID NO: 108 - DNA, 19 bp, Artificial Sequence
  PCR primer
ctgctcgaccctcgtacct

SEQ ID NO: 109 - DNA, 20 bp, Artificial Sequence
  PCR primer
gaaaagctggcgttttaccg

SEQ ID NO: 110 - DNA, 26 bp, Artificial Sequence
  PCR primer
agagctgccaccttgacaaacaactc

SEQ ID NO: 111 - DNA, 20 bp, Artificial Sequence
  PCR primer
caacacgaggtacgggaatc

SEQ ID NO: 112 - DNA, 27 bp, Artificial Sequence
  PCR primer
tcctccacaacaacccactcacaaccg

SEQ ID NO: 113 - DNA, 20 bp, Artificial Sequence
  PCR primer
gagctgccaccttgacaaac

SEQ ID NO: 114 - DNA, 20 bp, Artificial Sequence
  PCR primer
tcctccacaacaacccactc

SEQ ID NO: 115 - DNA, 3597 bp, Chlamydomonas reinhardtii; identical to SEQ ID NO: 85

SEQ ID NO: 116 - DNA, 1065 bp, Chlamydomonas reinhardtii
atgccgtcgacgcttcaaggcacgttccacacctaccgcattatcaggcggctgggacaaggagccttcggagaggtgtctctagcgggcgtactggagacgggtgaggtggtggcactcaagcgcatccacattcgcaacaccgggggcatacctgacgtggtggtgcgcgagatcaaggcgctgcagagcgtgagccatcccaacgtggtggcgctgctggatgtgttcccaaagggccaggccatctacctggttcaggagtactgcaccaccgacctggcggcgctgctgcggcggctgcccgcgcccccgccggagcgcatcgccaaggggctcatgctgcagctgtgccgtggcctggaggcgctgcacgcagagggcatcatgcatcgcgatgtgaagccgagcaacacgctgctgtccgccgcctccggcaccgccaagctggcggactgcggcctggcgcggccgctggacggcggcgagcggcccgcctacacgcacgcggtggccacgcgctggtaccgcgctcccgagctgctgtacggcgctcgcgcgtacggcccggcggtggacgtgtgggcgctggggctggtgttcgcggagctgctgggcctgtctccgctggtccccggcgacaacgacatcgaccagctgggccgcgtcatcgccaccttcggctctatggagccagtctggctgggcgtgcgagcgctgccggactggggcaagatcgccttcccgcactgcgagccgctgccgctgggcgacctgttgccgggcgcgccggcggcggccctggagttcctggcggccttcctcaggtacgacccagccaagcgcatcactgccgcgtgcgccgtacgcagcacctacctgaccgccacgcagccgctgccggctgacgaggccgaggtggcggcctggctcaccgccacactggccgccaacgaggcggcggtggcagcgctgaagcagcagtcggcggcggggtcggcggcgcagctgcacgtgggaagcgcattaaggcagccgcgggcggcgtcattgccgctggtgtga

SEQ ID NO: 117 - DNA, 1539 bp, Chlamydomonas reinhardtii
atggcgacccgagcagttctccagacgtttgagcggtatcagaaggagcgggtggccttcgtgaccgcggtggcagaaatggcaaagaacccgcaaaacatcgaggccctgcaacaagcaggagccatggcactgctgcggccgctgctgctggacaatgtaccaagtatacagcagtccgcggccctggcgctagggcgattggcgaactacagcgacgatcttgcggaagcagtggtgcagaacgaaatcctgccgcaactggtgtactctctgagcgagcagaaccggttttacaagcaggccgcggctttctgccttcgtgcggtggctcggcactccccagagctggcgcagtcggttattgacagcggcgcgctggattcgctagttacctgcctcgaggagtttgaccccggcgtcaaggaggcctcagcctggacgctgggctacatcgcgggccacaacgcggagctggcgcagcaggtggtggacgctggggcggtgccgctgctggtgctgtgtgtgcaggagccggagctcagcctgaagcgcatcgccgcctcggccctgtccgacatctccaagcacacgccagagctggcgcaggcggttgtggacgcaggcgcggtggcataccttgcgcccctggtcatcaaccaggacgctaagctcaagcgccaggtgtgctgcgcgctcagccagattgccaagcacagcgtggacctggcagaagtggtggtgggcgcggagatcttccccaaaattctcacttgcctcaagttcccggacgagttcgtcaagaagcacagcgccacggtggtgcgcgaggtcgccaagcacacacccgagctggcgcagctggtggtcggcaacggcggcgtgggcgcgctggtcgactatatcagcgactctgcgggcaacaaccggctgccgggcatcatggcgctgggctacatcgccgcgttctcggagacgctggcactgtcggtcattgcggagaaggccctgccgccgctagtgtcggcgctcaacgaggagccggaggaccacctcaaaagcgccaccgcctggacgctggggcagattggccggcacacgcccgaccacgccaaggctgtcgcagacacaggctgcctggcaacgctggtttcgctggagagcgacggcgcctccagcgacgacctcaagaccaagtgccgccgcgcgctcaagtccgtcatcgccaagctcacgcacctgcccgcgctggacgcgttggtgcaccggcaactgccggagagcgtgatgaagatggtgctggagcaggtgggcaaggtgctggccaacgacgcggcgggccgcgcgcagttcgtgcacagcggcggcctggcggcggtgcagcagatggcggaggcgcccggcagcaagctgaaggaggcggtggagatcatcaacagctgctaccccgaggagattgtcaagtactacagccccagctacagccagcagctactagagaagctggagagcatggccgcaaccactacggcgtactaa

SEQ ID NO: 118 - DNA, 2586 bp, Chlamydomonas reinhardtii
atggggagcttgggccatgaagcagtcgcagcggcgcagttccgtgccgctgagttggcgaggcgaacagtggaataccatagttcccgcgagggtgagcaccgcgcacgcgaccgcttgggcggccgcttcacgccctacccctgggccgacgcggcggcggcggtgctggcagatgaggtgctcgaggacgaggagctggtggtggcgctgatccgggagctgggcaggcagggctgctctgaggtggcggtggccgcactggacctggtgctgtcacgtgccgggtctgacggggacggggccggggccgggccgggcggtctgccgccgagcaaggggctgttcgactcggcgctactggtgtgcgcggcggagtaccaggatgagcgttgtgtggccctgtaccggcgcatgcggcaggcggggctggcggcggacgtggggtcactcaacctggcgctgacagggctgtgctgccggggacggctggaggaggcggtggagctgctggagcaggaggtggaggacagcggcggcgtcatcaagcccaacagcttcacagtgctcatgatactgcaggcgtgcaactacaagcggcgaggtgcctaccgggaagccatcgacgccgtgcgggctctagagtcgtgggggcggcccgccaacgaggaggtggtggaggcgctgctgtgtgtgtgcgaggctgccatgcacaaggcgcccagcttcgaggcggcggtggaggtgttcagcgcgctggcggagttgcagctggcggacagcacacgcgtctacaacggactgctgggcgcggcggggcgggccggcaggtggcgagaggcacaggcgctgtacattgcgatgcaggcggacgacatccccgccagcctggagacacacacagccctcatccaggcgtgtgtggtgggccgggctctggaccacgcactagacatattcgagttcctggtggcgggccgcgccgcgcacgagctggtgccggcgtccatccagacctacaaccacctcattcatgcctgccaccaggccggcatgctggagaaggccctggagatcgcggcctgggttcagaagacgggtgtggagttcaacgacgagacgtacgaggagctgatggccaccattgaggtggcgcagctgtgggatgagaaggccatgaagcaggccctgaagcgccacccggctgtgctgcccaagcacctccggcccgcgccctatgacgccatgcgggtgctgtacctggaccacctggagactctgcagcaggaggagctgctggcgctggaaaagctgggcacactgggcagctgggcgcccaagtcgctcaccaagggcctcatgggcgagcagcacgagcagatgatgcgcgagcagcagcaggcggcgggcgcgggcgcgggtgccggcggcaactggacggcctcggcagaggcctccagctggcgcggggctggcgggctcggtctggatgcggaggcgtccactgcctcggtctcggtctcggccccgggtccgccgctgtcgtatcgggacatggccgcagccatgcgcgcgtccatgcccgctctggcttttgggggcggtggcggtggcggcggcggcggcggcggtggcgcggcgacggcgctggcggccgtgtcaggcgtcgtcgggctgggcggcgagtcgtctgttagctccctggcaggcggtggcggtccgccggcgggcgccccctccatgcggcagctgctgaccagcatgtccatgaagcggatagcgggcggcggcaatggcggcccgggggcagggtcagcgtcgacggcgctgtcgttcagagcacctggcatgcggagtctgctaggcgcagcaggagcagctgtgccagactcacctactgcctcctcagccgccgccagtgcctcctctcccgccggcgcagcggcaacagtaagctcgcagcagctgggagcgggcggcggcggctccgaacctgcacccaccggctttaaccagccgcccacgtgggcgcaggtgcaggtggcggacgcggccaccgcgggccccggcggcacgccctttgtgacgcctcaggcggcgtcagtgcgggcctcggcggcgggcaccgtgccgccgctgtcgctggggtcgggcctggcgctggcggtggagcccgccaacctgcagggacagccctcggccggatcgctgggcggcacaccccgcgtgtcggcgcgcggggtggcgtcgagcagggcaaggcctgtgccgccgccggtcgcaaccgcgggatcagtgggtgccggcggactgccggcagtggccggggcgggccagggtggcggcattcatgcgagtgctggtctgctgccgctggcggacgcgggcccagcgctgggcagcccgcggggtgcgggcgggccactgccggctgcggcaggcagtcggttgcgggcgctcaatcccagtcttcaagtggcggtgggcggcccggtgtcgcatgacttcctgccatcacctttgcccactatgccacccacctcattgggcgccggcagcgggcggcggccgggcggtttgcggtga

SEQ ID NO: 119 - DNA, 19029 bp, Chlamydomonas reinhardtii
atgcgggcgctggtgggccggctgcaggcgctgctggagcagggggcggcaggaggcggaggaggcgggggaggtgggggcgctggcgaggaggcgggggtggcgggcgaggcgggcgggcgggtggtgctgctggcggcccgtggcgtggcggccatggcggagccggtggcggcgctggaggggcagcagggcctggcggcgctgcttcgctcgctggcggcgcgcgccgccgccgccgggccgccgcttcccgccgagtccgagctggcggcactgccccccgggtcggtgctggcggcggcggaggcggcgccggcggctgtgtacgacagcgggagccgggtggaggcggcggcggtgctggcggctgcggtggcggcggtggcggcgcgggggccggttctggacgacgcgggtgggcggctgctgcgggagctgcttgagagggtggtggccggctactcgctggtcgcggccatgggtgtgctgcagcggcgagtgcacggcgagctggcggcggcgctggcggcagtagcagcgcaccagcccgcccgactgccggcgctgctacagccgctggcggcgctgctgctcagcctgtcgctgcagcagccgcagctgcagccggacggcggcgtgggcgcggcgctgggagatgcgggcggcggaggtgcgggtgcgggtggcggcggcacggcgctgctgccggactcggaccccgagcagcaggtccggccctgggaggtgtacatagagctgtggcgggcgctgctgctactgccggtggggcccggcggccgcctgggcagtagcagcggcggcggcagcggcagtagcagcggcggcttcacggccgagatgcaggcggagctgtgccgcacctatagcgccgccacccagcgccgcctgcgtgccgccgtgtacgacgccctcatatccgccgtactggacgccgcccgccacttggacctgtcgtacagcctgccgccgccaggcggcacgggcggtacggcaggtgccggttacggtgatgatggggatgatgatgcggcggttggcggcggcggtggcggtttgacggttgtaaccgacctgtacggcggcctggtggccaacgacctgtacgacatgatggccttcttccacatgcgcgattttctgggcgagctgctgccggccgccgggcccggcctgttcgcacgctgggcgctgccggcggctgaggcgctgtgcggcctggcggcggagcggcccctggtcagcgccacatacagtctggccaaggtggccatggatttagcagaacaggccggagctctggcgcccccacccgccacacccgcagccgccacagccgcagccgtagccgcaggaacccgtcgctacggtggcggcggcgcggggggcgcaggtgcggcggtggcggagcaggaggaggaggcggacgtggcggcggcggcggcgcgcgcggcggcggcgacatcggagctgttccgcggactgctggcggcggtggcggcggcgtgtccgcattacaaggacgagctgctggtgtgctgcctgcagctgctgctggcggcgccgccgcacctgctggcagcagcagcagcagcagcagcagccggcagtagcaccagcactagcggcggcagcagcagcaccagcagctacagcctctctgctacagccgccggccagggtctggcgctggcgctgcggctggcgctgccgctgggactgcagcaccttccggtggcggcggcggcggtggaggcgctggagcggtgggagcagcagcagccggcggcgctcagggccgcgctgccgtactttgtaccgctgctggagccgtacctgtccgagcagtccggcgcggcggcgctgcaggccgaggccgacaacatggcggcggcggcggcggcggagcccggcggcggcggagcaggcggcggcggcttcggggagggtgctaagagcggcgtggcagctgctcgcgccagccgcgccgccaaggcagccaaggccgccgcgccggacgcggcctccgctctggagggcctgcagtgccggctgcagctgtggctgggccgcaaccccgccgccgcccgacacctggtggcggtggacctggcgtcgctgctactgccggcggcggcggctgctactgctgacaccgcgctcggcagtagcagcggcagtagcaacggcggcgtggtcgggcctgcggcgcagcggctgctgcagcagctgccctgggacacggactcgaccaaggtggcgttgcgggtggcggtggctgtagcagcgccgccggcggaggccgccgccgacggcggcgcggacggcgcggcccccgacggcagtagcagtggcgatggcggctggagccgagtggtgttgcacctggacctgctactgccgcatgcggcgcggctggcggaggagagcccggcgccgcaggctcggtcggcggcggcggagctgctgcacgcggcggcgctgtgggtggtgggagccaacgccgcggtgcctgaggaggggcagggccgccgtgactacgagcggcgcgtcacgcgcttccagccgctgctggcgcggctgtttccggtggtgctgcggctggcggcgggtcccgagcccctggcgcgtgagctgttccggcggctggcggggcagctggtgcactggtacacgcggggcgcgcggcgcgagggagctgaggccatggcgctgctggaagccgtcctggctggactgtgtggcggcggcggcggaggcggaggcgggggcggaggaggaggcgggggcgggggcgcgggaggaggcgcggggtcgctgcgggacctgtgtgcggcgctgtgcgcggagtggttcacgtgggctcagaagcagaacctgggcagcggaggcggcggcggtggcggaggcggtgaagccacctcctctgacgccttcgtgtcggtcaacgccgccagcctgctgcgccgcctgctggacagactggcgcagcccgaccccggcgtgcggcgcggcgcggcggcggcgctggcggcgctggcccggccgctggcggcgccggcgctgggcggcggcgcggcggcggcgggcggtgtgctgctggaggcgctgtggctgctggcggcggcgttgaggcacccgctggcggacgagggcggcgacggcggctcctcctcggctacagccgccgccggcagtagcagtagcagcaatactgccaccaccaacaacaacaacaacagcggcggcggcggcgcgggcggcctgggctacggccccgccctgtcccgtgcggtggcggcgctggtgcaccactgcctcacccgggagctggcggaggagctcacgcggcccctgcccggagaccccagcctgctgctactgccggctgcggctgctgctgctgctgctgctactgcggggaggggtcgtgggtgtgctactgccggggctgccggactgagcgcggcggctgaggactatggcgacggcggcccggacgcggacgtggagtggggcgaggaggaggaggacgcggaggcggcagggggcggggcaggggatgtggagatgcgggaggcagggcagcagcaggggcagacccagggcgggctgggtctggggctggggctgtcagctgcggtggtggtggtcccgccttacagcacactgcagacgctggtgctgtggctgtggaagggcacgggcggcctggcggcggcggcgggctcggctgcggcgcggcgtgaggcgatgcggctgcaccacaggctggcgggggcgctgctggaggtccgcgcacaggaggaacgcgaccggcgcatcaccgaccgcggcggcggcggcggcggtggcccccacccggcaccgggggcgggcgggctgctgtcccatatcctgatgatggggggcggctcacaggagggggaggaggaggaggacggcttgggcagccacggagcgcacggggatcacggcggcggcacgggtgctgctacagccgctactgccgctgctgctgctactgccagggtggagcacgcgggccccgcctgtgcggcgctggcggacctggggcggccgctgggctacagcgcctgctgggtgagctggcgcgtggcggtgcgctacagccgtagcggcagtagcagcagcggcggcggcggcggcagtagcagcgacagcgcgcggctgcggatgctggtgccgttcctgctcacgcagccgccggcggcggcgctcacggggcccggcggcggcggcggcggcggtggtgcggatggcgcagaggcggcggcggcgggggctgctgcgcggtgccgcgtgtggctgcggtctgtgacggcggccctagactggatgcgttgggccctggaccagggggtcctactggccgccgaccttcccgacctagtggacatggcccgggaccgggccgcccgcgacacacaggaggcggcggcagcagcagcagcagctacagccgcagcagcaggagtagctggggaggaggacgaggcagaggactggagaatgcgaaggaggaggaggcgcggcggcgcgcccccgcagccctgcgccaccctgcccgactccctgcttgagctgctgtgccagctgccgccggtggaggaaggcgtgagcggcagtagcagtagcagtagcagcagcggcgcccagggcggcggcagtagcagcggcagtagcagtttgctgctggccggcgccgggtgccgcggcgccacgcgggacgcctgcctgtcgctactgcggctgatgcaagcgctggtggagctggaggcgcaggctgtagcagcagcagccggcagtagcggcagcggcggtagcagcaccggtggcggtggcgctgctacagccgccgctggcgacagcggctgcgactactgctgccccagtgaggcgctggtgccgtggcgggaccgcgacactgccaatgtggtgctggcggcggcgctggccccgcacgtggtcggggcggcggcggcggacgtcgcggcgcgacgcatgggcggcagtagcagcagcagcagccatgcgggcacgagcagcggcagtagcagcaggggcgcggcggggccgctgactgccaccctggagggtgggctgcgtgagctgctgcggcgcacgctcgactcggctgctactgccctgggcgctggcggccgccccggcatggcggctggtggcggcggcggcggcggcggcggcggctggggcgaagccgcggaatcgatggaggtggatgaggtgggtggcggtgaggaggaggacgaggaagaggaggacgaggagggaggtgaggcggaggcggctgccctgggactggggctggggctgcgggcgtccggcaagagcggagctggagagccggcggacgcaggagcagcggcggacgaaggagcggcgacggcgcgtgtggaggcggcggcggcggcggcgcatgtggaggcggcgcagcggcgtgcgacggcccgggcgctgcggctgctgggcggtcgggcggccatgctagcaggcgacccactgcagacgtccgccttcctgacaggcctgtccggactgctggcgctgccctggcccgccgcctccacgaccagcggcagcggcagcggcagtggcagtagcagcggcagtggcagtagcacctccctggtgccggagccgctgcgggtgcggctgcggggccggtgtctgcagctggcgcggcggctgccggcgggcggcgaggcgtcgccggcggcacgcaaggccgccacagacgcgctcagcctggcgctgcagctgcagctgcccgccgccgacctgctgcacgtgctactgccgctgccgccgccacccggccctgctgctacagccgccgcctgtgctacagccgccgcctggaccccagcagccctggagcaggcgcagtcgggcgccgcggacggggccgtgttttacgacaacttcagggccgtggtgaaccgtgccctgctgttcgaagcagacacggccgtacggcacgtgatgaccgccctggcggccagcgcgcagctgctacagccgggcagcgctacagccgccgcgccagaggcagtagcggcggcggcggcggcggcgctgcgtgctacagccgaggcggtgctgggcggcgtgatggagagcctcatgcgctcccgcgccgccgccgatgccgccgctgctactgccgcggccgctgctgccactgccgcggctgcagcctctgccggtgccgcaggcgccgccgcctcgcagggagcggcgggcgccacgcaagccgcgcgcgccacccaagccacgccagccgccacgccagccgccacgggcgcgcccgctgcgcccccgctgcggccgcccccgccctccttgccccgcgccgtggacctgcacctgtccgccttcaccgccgccctgcgccgccacctgcccctggcggcgccgctggcggctcgcggctcgccgcccgagggccgcctgcttctgctgcggctgctgcggctggcgctgcggctggacgcgccggggctgctacagccgctgctacagccggcagcggcgcatggcgcgggtgctgctacagccgcggcgccgtcctcgtcctgcctggccttcatcctggactgctactgctccatgctgtcaccgcagcaggacgccagcgtcacctggacaccggcgctgcagctactgccgctgctggccgcacagctgccgccccagcacgcagtgctgggccgcctgttcacactcggcagtagcacgggcgccgacggcagtagcagcagcagcagcagcagcagtggcgttaacgctgccaccaccggcgccgtcagtgcgctggtggcggcggtcatcccgcccgacagccgccgggagctgggggacgccgccgccgccgccgccgcctcgcccgccggcgccgccctgtcacagcggctacacgctctaatgctgacgctggaaggactggcggcggccgccgccaccgaagccgcagtagcagctgctgctaccgccgccggtgctgctactgccggtgctgctgctactgccggttcagcggccgcagaggcgggcgcgggcgcggacgggtctgggtctgggtctggggcgggtgtgcgggcggctgcggcggaggcgctcctccgtgacctgctggtggtggttcaggacatgggcggcggcggtggcggtcacgtgctgcagagccgcctggccgccatgttcacacgcgtggccgcagcggcctggctgggcttccccgccgttggtgctgctggcggtggcggtggtggtggcggtggcggtggtgctggtggtggtggcgatgaggagtcggggagccaggaggaggcggcacaggcggagatggaggcggaggcggagcgcgcgcgggcgtggccgggtgcgaggctggtggcggcgtgctggcggtgggctggcggcggcggcggcggcgtagacggtagcggcggcggtggcggcggcggcgcgttgaagcgggagctgcggctggcgctgctacagcacgtgctattgccgctgctggcggcggcgccgaccgggttccgcgtctggtggtacggcagcaacgtacggcggtttgtgcagtacgtccagaaaaccgccgccgccaaggccgacccagtggcggcggcggcggcggcggcggcggcgccggaggtgctggcgggcgcgctggcggcgcggtgtgcggctctggtggactcgtgggtgtcgtacggactgctgcggagtatgtacggcacgtgcagcgcggcggaggtggagcgcgtgtggggcaaggccaatgagcatctggcgccggccagtggcggcggcggcggcggcggtgcgttgaagaacggcgtggtcatgtcggcggcgtgtgcggaggtgtgccgcccgccgccgcccgccgccaccaacgcggcggggctggagctccgggatttggaccgggacgtgcgctgcgcggcctgggccgccgccgccgcgctgctgctgcgcacccagtcgcgcgcggccttcttcgccaaactgcttagaccggacgcgggcggtggcgctgcggctgtgtggggcgcgctgctgcggcaggaccccgccttcatgctgcccaccgtgctggacgagggcgcagccggcggagcaggggccgcgggcgcagagaggcgcaagcggctgcgcaaggagcaggaggcggtgcgggagatgtttcggtcgctgcgccgccaacgtgacgccaacgcggcctggcacgcggcggcgacgctggcggcggcggcgggcgggactggcggcggcggcggcgcctccgccagctttatcatgggcaccctcggcggcggcggcgccagcctctactacactggcggcggcggcggcggcgacgtcgccagcctgacggccaaggtgtcggcgtcgcagtttgatctgggtctggcgtcgacgtcggccagcctggctggttcggctggctttgccggcggcggcggtggcggcggcgccgccgccgccacgccgccgccggcttcctttgcggcgtcgggcgcggcagggccgggcggcaaggccggggcggtggcggcagtgccctacacatggagtctcagcggcggcggcggcggcggtgctggtggtggcgatgacggacggccgctacccgccgccgccgctgcagccgttgacccggcggttgggctggcagcggttgaggatgaaaacttcctaaccgactccctgacctttttggacgacgagatggacgagcacgtgtgcatgctgccgctcgtccagctgatagagaagtacagcgacccgggcagttgggacgccgcgaaggaggcggcggcggcggcggccgcacgtgccgcgctgttccccgccgccagcgccggcggtggcagtagcaccagcggtggcagtagcacaggtggcgacgcgcccatgccttcttggctgcagacgctgtttgaggcgctcaatagcgaccacacgcccaggtacacgcggctgttcctgctcaaggccgtgctgcatgtggagtaccgccaccagcaggcgcgcatcgcgggcacacgccgccgctaccaggcgcaggctgtagcggctgtagcagcaggcgcgggccggggcagtagcagccagcgggcctcgcaggcggtagcagcagcaagtggtggcggtgtgggcagcatgcgtctgagcagcctgcaggctactgccgccgctactccctcggcgagcctgggtgttggcaccacacaggctacacccggcggcggcagcgccgcagcagcaccgcagcagcagccgccacagccgccacagcagccgctacagcctgcgggtgcggacttctcgaccaccgtgtttgctgtgtgggccgagcacttcttccccgcacttgtggcggcggaggcgctcggggccggaggcggcaatgcagccgccgccgccgccaccgccggcagcccggatggcggcgacgcggcaggcccggtggccggcggcggcgaccgacacaaggcggctgcacggggcggtggggcggcggaaggcggcgagagaagcggcgaggaggatgatgaagatggggaagaggaggattttgagccgcagctggcgcagcgccggcctgagggcgaggccacgctcacacagctgcggcgccggcaccagcagtacggagcagccggcggtgcaggcatgggtgcagcaggtggggccgcggcgcagaggctgccaggcatgggcgctgtagctgcaggcgctgctacagccgccgcagcgccaggcggcggcggcggtggcagtggcagtagcagtagcagcagttgcgggccgggcacgcttagtatcgtgacgcggctgctgatccagaccattatgagttggaggaagctggcgccggccggcagtagcagcagcaacagcggcggcagcagtgttgacacgccggcggcgggtgctacagccaccgccacggaagacgctggcggcggtggcggcggcggcggcggcctgccgcgtgggccgctgcgcgaggcggcggagcggctgctgcggcgctgtgtgtgtggctgcctgcaccccaccagcgcagaccagagccgccacaacgccaaccacgtcatcacgctgatgtacttctggcgccgagccggcgtgtcgctgctgggtcgcgagctggtgccgctgctgggccggcggctgccccagcggcagcgctgccagggcctgagggtggcgcgggcggcgctgggctacggccaggaggaggcggtgatggcgggcgaggcggctgcggacatctggaaggcgctggttggcatcaccgcctgccgcccgccgccgccgccgccacacaccaccagggcctcaggagccggcggcggcggcggcggcgggcacgcccaccaccactacaccggcggcgccgccggcgcccctcagctgtctgtggaggcggcgccgctggggcagctgttgggcctctactttgccaaactggcggagcgggaggcggcggcggcggcggcggcggcggcggcgggggacgctggtggcggggcaggggcggcggcgacgcccggcgcctggggctgggcgggcgctgccgcggcggcggaggcggaggaggaggatgagggggacgtgggcggcgggggcggaggcggactgggcctgacggctagggcgaccaagcgagcgcggctgtcaggaggctcctcgctcaaggacaagatgcaggacatccggtcggccctgcgtgaggccaccgacggcggccgcaactgggaggcggcggtggaggtgcttctggggctgtcgcagccgccgccgctagggcacccgcccgcagccgggcccctggcgccagagctggtcaagcggctgggcgtgttgcgcgacgtgcgcatggccgatgcgctcctggtgctcaggcgctgcgcgctggtggcgtcgcccgccgccgcccgcggcctcttcatcgacctgctggcctcactggacaggctgccgctgcgctccatgcgagtggaggcgcaggtggcggctctggagctggtgcaggccctggctccccgcgctccgcccgagcagcttcagcggctgctggcgctgctgttgcgccgcggcctggccgccgcccccgaccccgccgcccgcctggccctactgcgcctgtgcgccgcgctgtgggcgcagcgggggctggcctggccatcgccgcccaggcagcagcagcagcagcagcagcagcagcagcagcagcagcagcagcaacaggaggcaggcgcagctgctgctactgccgatgcggcggaggcggcgcggctgctacagccgctgctgctgccgctgctggcaggggcgctgggcgacggggacccgggcattcgggcggcggcccgggggttctggcaccggctgctgccgcccgcgccggcggagcgactggcggcgctgatccgtcttgcctcggagccggccctcacgcccaccacctccaccaccgcctcccccaccgccacagccctagccgccgacgccgccgggcggctgcagcgcggctggcccggtctggcggcggggctgctgctggcgccctccctggagccgggcagcgccgccgccgccgccaacgccgcggctctgttcaccagccagccctatgagtgcgagttcagggactacacacccagcctattcgcgggcggcggcggcggcggcttcggcggcggcggcggtgcaggaggcggcgggtcgctgtctctgcgcacgcccgcgttcatgatgtcacaggacgcctcgcaaggcggcggctacttccgtggccggcagcgcccgccccgcggcctgctgcgcgccaccgcctccgtgtccttcaaccccacagtgtcgttgtcgctcaccggggccggcggcggccccttcgcagcacccctgggcggcggcggcggcggcggcggcggcgccagccaggcctcgggcggcggcgcggcgttccttgggccgtcactggcggcggcggcacagggcggcggcggctcgcagcagggccttgccggcgcgagccaacagcacggctacagcctgggtgctgacggcagcagcggcggcggcacgagcggcggcgacgtcgtgcgtttggtggctcgcagccgcgcctacgtcggcgggggcaacggcggcgccggcgacaccaagcccggcggcggcggcgccaacttcgcggcgcggctgcggggcatgcgcgcgcaccaggcgcggcagctgcgcatggggtcgctgcggcgtcacggccgcgcggcgcgtgtgtcgctgttgcgcagctaccgcaccggcgagctgcccgacacgctgtcgctaaggctgggcgagtccttcctgcggccgctggcggcgctggtggaggccgacgccaccgccgccacggcggcgctggcggcgctgacggcggccgtgctggaggagggcaacaccgccgccgggtcggaggcggcggcggaggcggcggcggacgtgcccgccgctggcgcggcggagccggctggatcaagcggcgcggcggcagctgcgggcggcgatgacggtagcctggtgatcctgcggcagcagcagccgcagcacgccagctccgcagagcagcgccgcgccgctgccgagcgcgagcgggccgagcggcggcgggcggcgcagcagcgggggctgcacgccgcgctggcggccggcttcggctgccggcccacggcgccggccttcgtagcggcactgcaggcagtagcagcgcgcttcgccgaggccgcgctacagccggcatcactcaacggaaccttcccgccgccggggcagcctgctactgccgggggcgcagacgctgcagcggactcggaagcagcggcggcgggggccgtagcagcgccgccgccgccgctgctgttgctacagccggccgacgtgctggcggcggcgggcgcctgcggcggccagcaggcggctgctctgcttctggagacgcagcaggcggcgctggaggagcgcggccgccgcctgcaagagcagcagcagcagcagcagaagaagcagcagcagcaggctgcagccgcgggcggccgcagcggcggcagtagcagcagccgcgccgccagggccgccgccaatgccgtgcaggctgtacagatcgggctgcatgacacactggaggcgctggctgtggcgtacggcgatctgggcgagtccgacgtggcggcggcggcgcgggcggggctgctgctgtgtcccgtgacggcggcggcgctggcggcggaggcggcggggcggccgcggctggcggtgcggcggctggggcaggcgcaggcggcggcggagatggtgcaggagctgggccctgtcgcggcggcggggctgcccgtgcccgagcggccgcaggacttggcgccggccggcgccgtgactgctgcttcggcagatgccgccgccgccgccgccgccgcgggtggcactgtcggcgaggttactgtggcggacctccttggctctcaggccctggcggctgcagccaccactgcagcagcagcagcagcagcagcagtagctggcgctggcaatggcagtggcggtggcggcaaagatgtgggcggcacaagtggcggcggccgcacaggtggtggcggcggtcaggggttggcggcggcgccgccggccgagtcacggctgtggcggcaggtggtggtgcgatgcgcggacgcgctgggcgactggcagcgcgtggagacggagctggaggcgcccgtgcaggagctgcttggggcagcgggggccgccggggccgctgccgggggcgtcggcgccgcttcctcatccacctcgggggcaggcctgttcacgggagctgacgcggcgccgccggacctgctggcagcagccctggtgcgcggcctggcccgcggcagtagcagcagcgcaggcggcggcgttaacggcaacggcagtagcggcggcgccgccggctcggcggagctgctgcggcgtgcgctgcgtgcggcgctgttccagcttcgtgagtccgacgtagcgccgtcgggccatgggctgggcgccatcatcggcggcggcggcggcggcggcggcggggatgtcatgatggcagatgctgctacagccagtgacggcggttcgcatgccgccatcgcggcctggattgaggcgctgttggagcggctggatggctcgcaggcggcggcggcggcagcagcggaggcggcggcgccgctggagctggtggcggcggcggtggtgcgtgcgtgccgccagggcagctgggagcgatgtctgggggaggtgcagtcggctctggcccggctgcgctcgcgctgggccggcctgcacccgttgtcagccgccgcccgcgtcgccgcgctgtcgctgctacagccactggcggagatcagcgaggccgtgcggcaggtgctacagccgaccgcggcggctgcggcggctgcctacggcttacccgctggttcgttgcggctaagtggcggcggcggcggcggcagtagcagggcagcagcggctgtagcacctgggcatgcgcgcggggcggcggggccgctggcggagctgaggggcttggtggcgcgctggcggcggcgtggcctggggctggcggtggcggcggacggcggcggcggcggcgcgggcgccactgcggccggcagcgacctcatgtccgtgctgcacgtgcgccgtttgctgctgctggccgctggcacccgccgccccgcgaccgcgacgccgtccggcgcggcgacagagcctgctgcagccgccgccgcccgggcactgcaggccgccgcccgcgccgccgccgccgccaccgtgtttgacgccgcggcggctgcgctgaggtccgggtgtgtggacacggcggccgaggccttgcccgacttcgccgtgggtgacgaggaggtggtcgaggtggtggagggagctacggccgcggcagagggcgcggacggggcagcggcggaacggcgggcgcgacagcgggcgcgggcgcggctgcggctgtttacggcgcacaccgacgcggctgtggcgcaggcggcggcggcggaggctgccggcagcggcggctggatcggcagtagcagcagcggcagtagcagcgatgttggcggcactggcggcctgtcgggttatgattggcgtgtgtatgagggactgaatgggctgctggcggcgctgaggccgtggctcaagggcgcgacggtggcggcgacggcggtgccggtgctgggtccggggcaggtggcggcagcggagctggcacagtcgcgggcgctgctggcgtgggcggccaaccccgccgagccgcagtacctgaccgcccgtgtgggcgctgccctgttgagcggcgccacagcggccgcagccgccggcgccaacctgcagtcacagctgcagcggcggcggcagcagcagcagccgtccagcccagccccgcattcgcagcagccgctgcagttggtgctacagccgcacgctggcccccgcgagacggcagcggcgttgctggcggcgcgcgcctccgcccacttcgccttcatgtgcggccgcctgttgcgagcccacgacgccaccaccgccgccactgctactgccgctgcagctgacaatgctacagccgccaccggcagcggcagtagcaccggtgaccccggcatgccgccgctgaccgcgctgccggccaaggtgctggaccgcgcgctgcgtgccggcggcagtagcactggcaccagaggtgctgctgctactgccactgcggctgctgctgctactgccgcggcggctggcgagctggccggctgcctagtgaggcacctgctccgggcgatggccctggccggcagcgccccggtgacggcgggcggctgggtcctggggggtgaggggggcgagggcgaggctgtagcagccggcaggcacggcagtagcagcagccagcatgacggcgatggcggcggcgatggcgatggcgagggtggtggtgatggtgacgatgggtgcggcgggggcggtgtgccggaggtgcggctgcacgtgccggtggtgctgagtgtgctgcgagacggctggggcggcagtagcagcggcagcagcggcggcggcggcagtagcatctgcggtggtgtcgacacgacggcggcggcagcagccgcattccgtgagggctggtcggacgtgccgctgggctgcttcctgccgtgggcggggcagatgtgctccatgctggcggatctggattcagcgagtgcgggccggtcatctggatccggctccgacccgagtgcttcagatccagatccggatccagttttaggcccgctgactgcgctgtcgtacgcctaccctcagctgctgcacgcgccgctgcgcatgagcgcggcgggctttgcttcggccggcagcggcagtagcagtagcaatagcagtagcggcagtagcagcggcggcagggctgcggcagctgtagccccgctgctggctgccacggccagcccggtgctggagggcttcatcgacgccctggacgcagccacctacccggcacagaggtggcaggtgtttgtgtcgcgcatccgcggcgccctgcagcgcggcgggctggacgcagccgtgcgcgtgtggacacacgaggcctggcccaacctcttcggccgcttcctgccacacggcgcagccgccgccgccacagccgccgccgctggcgcaccgcaccgcgcgcagcgcgccacccgccgcgtggcggcggacggcggcgccgccgccggcggcgccgccggcgccatggcggctggcgacaccgtcaatgcggccttcgccgcccgctaccgcgccgcgtttgaggctcagttgggcggcgccgacggcggcgagctggcggcgctggcggcggcgatgcggcgggagcacgcggcggcgcggcgggcggcggcggaggggcggctgagcccggaaggagcggcggcggcgggcggcggggcgcggacgcgggaggctcggctggcgggcatgtcggagcagcaggcggtgtgtgcggccttcgacggcgcggtgcggaagatcatgaccacatgcatgcagcgcgggggcggcggcggaggaggaggtgggggaggaagcagctcgtgggaggcgctgcaggcggcggggccgcagccgctgtcctggttcagcccctggttcggagcctaccagcgcgcggcggaggacgcggcgacccaggcggcggcggcggcagtgacacccggcggcggtggcggcaacaggctgctccaccgcacgcagctgctgctgcccaccatggccttccccaccgccgccgcgccgccgccaccgcacggcacgccgccaccgccaccgcatgcacgcacccaccgcccctcccaccacccccaccaccacccgccccttcctgcgctgggctgtgaggacgtggcgccggtgctggtcactggcttcggccgcgacgtcaacgtgttcggcagcaagcagcggcccaagcaaatgacaatgttctgcagcgacctgagccgccgcacctggctgtccaagggcggcgaggacgtgcgactggacgagcggctgcagcgcctgttcgacgtcatgaacggactgcagcgccagcagccggcctgctaccggcggggcctgcgtgtgtcggtgtttgcggtggtgcctctgagcgcgagtgtgggtttgctggagttcgtgcccggcactcgcccgctgcagagcgtgctgctgggcgggccgggcgcgccgcgggacccggacgccggcgcgcgtgtggctctggcgtgtttcgtgtgtccgcccgccggcgtcccccccgaggttggcggctggacccgcggctacgaggccatgtacggagccatggggccggggcagcgcgcggagccggcggcggcgcgggaggcgtttagaaaggccgccggcgctctgcctccctgcctcctgcgctccgcgctgcttcgctcctgcggcggcggtcccgagctgttcctggcccggcggcggcgcctggcctccagcctggctgcgggcgccgccgccggctacctggcgggtgtgggcgaccgccacgccgacaacgtgctgctgcaggccgccaccggggagctggtgcacatcgacttcgggtacagcttcggcgcgggcacgcaggtggtgcccatccccgagctggtgcccttccgcctcacgccgcagctgcaggccgcgctggcgccggccgccgccgccgccgtgctggagccggcgctggcggcggcgctggcggcactcagcgggcccagcgcgcggcagctgctgggggcggtcatggaggtgttcctgcgtgagccagtggcggagtggcagcacgaggcggcgatcctgcgcagtctgcaggagtcagcggcggcggcgcaggcggcggcggcggcgcggcagcggcgcaaggggcaggagcggcaggagggcgcggaagcggaggtggaggacagcagcagtggcagtagcagtggcagtagcggaggtctggtgctcacggacgatgcgggaaccaacagcagcgaagcgccggcggcggagctggcccgggcaagggtgtccacggcgctccagaagctggcccggcgccacccctcgctcatcaccgcggacgagctgcggcccgtgcacggcgcccggccctactacgcagccctgtgcgccgcggtggcggggggggcggcggcggaccaggcaggcggcggcgggggcggcagcgtgcgcgcgcggctgctgcagcaggggcccctgctgggtgcgggtggcgcggggggtccgctgctgctgagcccgctgctgcaggcgcgctgcctgctggaggcggccaccgaccccaacctgctggcgcggacctacctggggtggaagccctacctgtag

SEQ ID NO: 120 - DNA, 1794 bp, Chlamydomonas reinhardtii
atgcgagctcttggctctggcgtaccgcgggtggctcgggccggtgtggccaggggcccggcaccgctgaattccttttggcgttcttacggctggggcgctgaaaagacgaaggaatctcagtttacttttgacgaccaccaagcgatcttcgagggccgcaccacgccggacctgctcaagtcgctgctcgtgctgcggctgtgctccacgccctccttcgtggcctcggcggagggcctgctcgccaatgcccggcgtgtgatgggcgacagcaccgccctcagcttcgtgcgcaccaccttttaccagcatttcgtggccggcaaggactcgggcgacgtatggggccgcatgaacacgctgcgtgcgaacggcgtgggcgctatcctggactatgccgaagaggaggacctgctcaccgcctgcaagcagcccgcgccgcccgccaccaaggcgtcggctggcgcggctgcgggcggcgcggcgcaggtgtctgcccgcgaccccctgggcggcgagtcgctgattgagtcgggtgtggcagcgaggacgtacacgttccaggacgacgccacgtgcgagttgcgcacacaggccttcctggcggccattgacaccgccgccacactgcccggccagggcttcgcggccatcaagctcacagccctgggggaccccgcgctgctggagctcctggcctcggctctggacgcagtgaaggccctgtttcggcgctatgacagcaacggtgacggctttgtcacgcggcagggcttcctggaggccttcgagcgcatcgagaaggcgcagggccgcagcagcacaggggcggagcgcaacgagatgtgggcatggctggacccggccggcgacggccgcgtcgactacgtgacctgggccagccgcctggacctacgccgcctgcctgacatggccgccagccttaggcaggagctggagtcgcagaccgacgcccgtggacggcagtgggagatgtcggctgaggagctgcggcagctcgaggcgctgtttgggcggctgcagcggctggtggcgcaggccgtcaagaagggcgtcaagctgatgattgacgcggagcagagccacctgcgccccgccatcgaccacatcggccgcgagctgatgcgcgagcacaacaagcccgtcagtgcgggcggcgagggcgccgtcatcttcatgagctaccaatcctacctgcgcgacgtggagctgcgcctgcagcgagacctggagcgggcggagcggcagggatacgtgctgggggccaagctggtgcggggcgcctacctgcacctggagcgccgccgcgcagcccaggccggcaccgcctcgcctgtgtgggaccacatgagggagaccaccgccgccttcgacggctgcctggacacgctgctgcgcggggtgcaggcggggcgggcggagctgatggtgggcacgcacaaccgcagcagcgtggagggcgtcatcgagcgcatgaacaagctgggcctggagccggaggaggcgcatgtgtacttcggccagctcctgggcatggccgacaacatcagcttcacgctgggacagcacggctacaaggtgttcaagtactgcccctatggccaggtggacaaggtgatcccctacctcatgcgtcgcattaacgaggcgcagtacacacgcaagggcggcaaggaggacgcggcgctgcttctggaggagctgatgcggcggctgcgcgacccggcgcactcgcccatcgcgcgcatcttcagcaccgcctcctcctaa

SEQ ID NO: 121 - DNA, 2478 bp, Chlamydomonas reinhardtii
atggactatccaccgctgcaacaggcgcctggatttgacctggccacggatgacagcgggcgagaccccaacatccctggctccttcgccgcagtggtcgtcaagcggtctgccaacctgcaagaggtctgcttgccgccggcctacgtgcccaatgcgaccctgggcacctggactcggcccacggagctgccggcagggaagcagatcacctactcgaccaacaccacgatcgtgttgctgcaccccaactgcactggtattggttttgacatgccgtacgaggagcagtgcatcaaatcttcgggaggcacgtttgtggatgtgggcgtgtactgctactcattggacccttttggaaaccaggttaaaaccggctacgtgtcgcacctgctggatagcgtgaaccggtgctaccagtacatgaccgtgggctgcattgatacgtacggcggtgtactcggctgctacaatttcatgatgcaacagcgccaaaacaataacagcagcagctcgccgcgccaggcagtgccgccaccaccgctggctcctgcaatgaccggcgtgggcgggcgcagcaaccagcaagcagccctcatcggcgctattgtgggcggcgtggtgggaggcatcgtgctcgtggccggcgtcgcgtgggccaccctgctgctggtgcgccgccgccgttatgcggaggcgccggcggcggcagcgtctggcagccggcacaagagcagtgacgacggcgagagcgggggcagcagtagcagctgtagcggcaagagcggcggcggcagtgaccctgttgaagctgcagcgaagccttgcaacccaacgtacgcctttagcggtggcagcggccctgagcacgccgccgccttgccgacagcagtggctagccatttacccactcagcagcagggcaaggaggaaaaggaggaggaagcggtggcggccagccatttacccgctcagcagcacggcaaggaagatgaggaggcggtggcggcggcagcagcggtggcggcggcggcggtagcggcggcgcctctttttgctgatgagccggcctcgctcgtgcctgtgacgcccttgacccctctgcagccccacatccctctcggtgtcacggtctgtgagggcggcagcaccctcgctgcagcaagcaggagcaacagcaacagcatcagtcttggcatccatggtgacagtaagagggcccccgtaagtggcggcggaccaagtggcggggctctcggcggctgcggcaccagcggcagtactgatgctgacagccgcgcactcgtgttcaagggtggcgaaatagcagcagcagcagtagtcggcgggagctcggtagtgccagcggcggcggcggccggtgtgacgaccagcagcggcggcggcggtggtcaaagcggcgacgcggccccaccagcaccgagctcagatgctgcgacacgtgctagcggcggcggcggcggcggtgcgccagcacatgtggtgctgaccggcgtcgtgatgggcaaaggctcatttggcagggtggttgagggtgtgtactgcggcaggcgggtagccgtgaagcagatttacacgggtatcctcatgcaacaggggacacagcagctacggcagcagctgctgacacagcagcagtcgcagcaggcacagcaggcacagcaggcgcaggaggcgcgggaggcgcagcagcagcatcttcaggatgtgcaggacagccttatcgcggcgttggagcaggaggtgcaggtgctggccagggtgcagcacgagaacatcgtgaccctgttggccgcaaacctcgagccgccgaacgtgtgcctggtgatggagcggatggacacgtcactggaccacctgctatacaaggaccccaacagacccttccccctgtcgctggcagtgcacatcgcgctgcaggtggcacgtgccctggcgtacctgcaccccaccatcctccatcgagacctgaagccggggaacgtgctcatctccaacgcggatgacacggcggctgcggccgacccgcacaaccaccagcacgttgttgtcaaactggcggacttcggcctgtcgcggctgcttgaaacggtccttgtcacgcaagagcccgaagtcggcacggcaccctacatggcgccggagtgctttgacctccagaacattgtcatcacagaccgtgcggactgctactcgtttggagtgctgctgtgggagctggttgcgcggcggcagccctggtcgaaacaaaatatgatgcaggtggcggtggcggtggcggtgaacaacgaccgactgcccctgctgcccctcgttgaggccggtgcgccgcccaagctgcagcggcttgtgacacagtgcttcgacgccgatccgcagaggcggccggcggcggctgagctggtgaaggagctgctgctggtgcagcagcagttggcttctgggtcgactgcataa

SEQ ID NO: 122 - DNA, 2166 bp, Chlamydomonas reinhardtii
atgttcggggaccccagctcagcatgcagtaccgatgttacaaacacgtggacagggaccgtgtgtaacggcacagcatggtacggcgtgggctgcacgggagacggatcggccgtgattaacaacacgggcttcgtggagtcgctactgctgccgaactgcttccctggaggagtcggggtcgcggcgtcgctgccatctcaggtctcggtcctgacggctctgacgcggctggacctcacgggcaacaagttgagccccaacagcggcctaccagcggactactctgccctgaccggtctgcgcctagtgggcctggcgtccatggatctggaggcgggcccggtgccctccagcgggttcccacaagagtggtcctcgcttgtcaacctgcagcagctcgacctgtccaacaaccggtatcttggtggcgagttgccgcaatcgtggacgaacatggcagcaatcgtcagcatagacgtgtcgaacacgggggcttgcggcacaatcccgggcggcctgagcagccaggtgacgccctcaggcctaccttcgtcctgtgagctggtgaactgtcggcgctacttagtggaaacgctgcagcccatgatcgacagccaggttcagcccggctcggcctgcaacctcaccagcgcgtggcccagcagcttgagcattgactcgtgggccggcattacggcaatgattacggtcgttggtacaacgcccgtttctgacgtcatcggtttcgtgctgaacggttgctatgcgagcaacggcaactccttcaacgtggtgttgccggacggcttgtcatgcttcggcagcctcacgcagctgctgttcaatggcaacaatgcagcaggccccctgccggacgcgtggacccagctaaatcagctgcaggagctttgggtgaccgacaacatcctgaccggcagcctgccggcatcctactccgcgctcacggggctcacgacattgaagcttcaccaaaaccagtttaccaacacgctaccgcctgagtggcaggccatgagcctgctcgcagacatcagcatcagcgacaacacccaactgagcggggccgtgccttctgcatggggcaacctcaccagcctcaccaccttcagggcgcggaccgtgggggttggtggccagctgccgccctcattcagcgccctgtcgcttctgacggagctcacgttcgtgtcggacaccctgagcggctcgctgccgagcgagtggagcacactgtccttgctccagcagctgaccatcacttccaaccgagccacgtccacgatgacgggcacgattcccaacgcttggtttgggcccggtggcattaccccttccatgtcgtcgcttcaggccatcacgatcagcaacaccgcaatttcggggcccctccccaccgacatgtcgcaaattttcagcctcacaaaactagacttctccgccaacaagctcaccggcggcccgacaccgtcgtctggatttctgttcgagtacaatacgctgcaaaacctgcagttgattagtcttgccagcaaccaatacctgggcggaaccgtgccatcggcctgggcagttacgatgtccagccttacatttcttgacctccaggacacgggagtgtgcgcgcccttcccgacgggtttgaacagcgcattaacacccggcacgtttgtcaactcgtattgcgaacttggcttcatgaaccagctcacgcgcatggacctgtcctgcatgaactccttgcgcacgctgaacctcggcggcatggacaagctcacagggccgcttccggaaacgctgatctccatcccgggcctcgctgatgtgacgattgagagtaactcccttacgggcacgttgcctgctgtatgggataacctgtttgcactcacaagtcttgtgattggtgcgggcggcaactcggcacccgggccaagtgtcaacggcacctttccgcagaactggttcaccagcggcaacctgaacaacctctggaacctgcgcatagcgaacacgaaggtgtccgggccgctgccggatcctggcagtaccttccaagccggctttatgggtctgacttctctggacctcagttccaacatgctcagtggaaccctgcccgactcgtaccagggcttctcgtaa

SEQ ID NO: 123 - DNA, 1146 bp, Chlamydomonas reinhardtii
atgcaggaggtactagctgcagcgcgagcatcgaagcaggtggcggagtacgcggaagcatcgcgtgtgagggtggttgatggctggggcgacggcctgcctgcggccatggcggctgcggttcaggcccgcggtggcggcctggtccgactgagagtgcgtcaggaccacgaggtggtgcagcgccagcgccgcagctggcgcgctcgagcggcacttgtggaagcgctggggattgagcggtatgacaacccaagctcagcggccaagctggtcctgctccaggcgaaacctggtgctgtgcttgcggacgtgtcgccgggggagcacatgtgcatggtgctgagcgcgctgctggggctactggcgtgcccagacctggaggatcaggtgtacaacgaaatcgcaggtctgcttgcgggcgtggagctggaccacggacgggcactgcgtcagcgcattggcgggaagctgcgtgaggcggtcgaggtgctggaggaatacgtggctcacctccggtcaatctcggacagcgcgcagctcccaaaagctgagcatgagctgcggcgggcacaggaagcgctggagatgttggcggcacccgccgacacagacgacagcatgctggaggtggacaccgttaaggtggtcgtggacatcatgactgggctggacgttaacgtcctcgtagtaagcctggtcgaccagcaggacctgggcgggcacgtcactgcagcgtacagccggaccacgcatgtggcgctgcgcgagctggcggtctcgggcggtggcgccctggagctgccctcatgcagcactgtagtgctgttttttgcgcacaatcatgcaaactccgttctgctgggcaaggtgggcgaccagaagacggaggtggaggtgctgctggacatggccgcggagacgcacgaatggaggcagggcggcgttgtgtcactcggcagcggtggcgcaattggagcagcggcagtacagcgcgggtctgcggctggctcgtttgtgcagccgcagtctgctgaggttttgcacaggttcgtgccaacttttgttccttgcgcttctgtcctgcagcgcgcggcacaatgggtgcagctcaacgaggcgtgcgtaggtataccccagacttag

SEQ ID NO: 124 - DNA, 3489 bp, Chlamydomonas reinhardtii
atggcctgcaagggctacgccacccagccccccgtgcaagtccggctgggcggcctgcgcaccgaggctgacggcacgctggtgaacctggaggcaccggagaacatgaacaagtccggcctcacaattgcgggtcgcacagtgacgatgtcggacaacggcctggcagtgttccagaacacacgccttcgtgcgcccgagggcccgcgcgtgctggagctgaacgccacgctgacgaagcccgtgcgcgagctggccagcgtcaaggtgctggtgtacgtgcggccctgcaccattggcgagttcctggaccccaccacaaaggacatgtgcattggctgcccgctgggcacctacaacatgatgccagccgcgacccagtgcgagacctgcccggacagcaccaactgcacggcccctgatgagggcgccatgatgctgcccgatgacggctactggcagagcaacctgtactcggagcaggtgctggagtgccccaaccccgactcctgcacgtacgacgcccgcgaggactcgctgcgtgagatccaggcggtgacgtggtgggcggtcaagtggatgcagggcaacgcctcacagcgcgcctccatgaacacactggcggaccaaaagtggaaagacctccttggccggcgccagcttcgaacgctgggggccaacgtggacgtggtgaagcccattgagacaatgagcgatgaagagttcgtgaacgcggtgtacaacctgacgtatgtttacaaccagaactacaccaccaccctgtgcgctgagggctacatgggcacgctatgcggcgcctgccagcccggctggggcctggtggacgaggccagctgcatcaagtgccccgccaagtccctcaacgacctgtactacgccctcgccaccatcttcaccatcttcaccatcggcatgacagtgctcagcagcctggaggcgcagaagaccgcgcgcgacattcgcgaccacggcctggacgtggcggaggtgcagcagcacaccgagaggctgcaccagctggaccccgcgggccagggctggcacggccaaacctcgctgaaccccgtgcgcgactccgtgggccctgttgatggcagccgcccgggcagccgcgccgccagcgtcaccgccggccccagctcgggcacgcagctgccccccgccgccgagggccccaacggcagcaagagccccctccgccccggccccgtggcggaagccaccgagaccgacggcggcgcgcccgctcccaccccgccgcccgccgcctcactgccaccggccgcgcaccagcaggccggcggcagcgccaccaacggctccggcgccttgaacgtcggtgctgtcgcgctcctgtttgacgggcagcaggcagacgctcacaagcccaagcccgacatcgcatctgccggcggcttggcgtccagcttccgacccgacaagagcggctacagtgcaaccgccggtgccagcggcacacagcgccagggctctgtgcagggaggcgtcaacgcgtcgggccgcctgccgtccaccaaggaggcgtacagcaagtaccaagggctgacggagtacgagattgacgagctcaagcgcgcggaggaggaaatgagggaggaggcgctcaaccgatacgctgccaaccagtccacaatcatgcgcatcttcatcagctacatccaggtgctggcgctgctgcgcaacgtgcccatccgctaccctgacgcctacaacaactacctcaaactcaacaaccaggccaccgcctacccaggagacatcgtcaccatggactgctcgctgccctacttcgcagccggcggcctgccgaggtccatgctcaaggtcatcctgagctgcgcctcgcctctctacatcctgttgggcttcgccatcctgacgcttttcggcgacatggccatctactacaagaagcggaagtcgcgggccaagctgatgaaggcgaccaagaagcgcgggatgagcggcaaaggcgtgccgctgggcgagagcgtggagggtcccgagccctacgccgccgccatcaccactaccacttccaacaataacaacggcttcaccaccgtgaatacctttgcccgaacaaagacctccggctccgccacggcggccggcggcgctagcagcctgcctgtcgccaacagctttgcacccggcggcgcccagcctgtgtatggcttcaactctggggccctgttcttcggcctggtcaaggacaactactgccccacgggccgggacgacccactgcgcaactacggcgcattcctgtgggaccgttacttctcacaggttctggttatgatgattgtcatcttctttgttctgtacccggacgtggtggacaacctgctcagcatcttctcgtgcgctgacgtggacttcgacaaggacggcaaccccctggcggtcaagatgggtctgtacaacaagcaggtctggacggtggactacaacgtcacttgctacgagggacagcactttgtgttggccatggcgctgggcatccccgggatcatcctgttcgctgcgggctggccctccatcaacgccgtgctgatgagcccgctgggccgccagctgtgcggccacaagacgcgtttcactgaggacatgaccgagtactacctgaacgactacaagcccaactttatctggtgggagtcccttgtgatgctgcgcaagctggccatcgcgctggcgaccaccttcctgggtagccgcgataccgacaccggcctcaacctgctcatctgcatgtccatcctggtggtggctgtgtcgctgcagctgtggttccggccctatcaccatgtggagaccaacacgctggaggccggctccatctgcgtgctgctgctgacgctgtacctgtcgctctacttcctgctggacgcgagcgtggtcagcaacagtggagccatcgccgtgtctgcggtcatcatcggcatcaacgtcgccatggtggccatcttcctgtactacgtcatgcgctcccactggcacacctacatcaaggacatgggcttcgatgcggaggtgcttcacggcatgtcgcgggcccagatccaccagcacatgtccaaggccatggatgacgcgctgcccagctttgtgccagagagcgtcaagtccgtcatcacgcgcgccgccacaggcacgttggcacacacggtggcccttcagaagcgcttctcctcacccgccagcctcaccgtcggcacctcggccgccacaatgggcacacacatctccggcccgctcagcccgaactcgccgtctggcgccaacggctctggcagtcccaaagtggggaccgtgaactcccttggccggccgcagcagcagggccagcccgaccgcgtgaacacgctggggcgcggcaaggaggaggcgaagcccaagcaaagcatcaaccccattgacaggctgaagtcgaacaagtag

SEQ ID NO: 125 - DNA, 714 bp, Chlamydomonas reinhardtii
atgatgaaccgaaaagcttggcataggatggtgcggcaagtggaggtgaagaaggccattccaaagccaaaagagatgacctgggacgttgtactagacctcgcaaacgatggacaggagcaccatgaaggtagtaacaagctaacagcagaagacctcgtccgtatcaggactgcgctgcacatgctggggaaagacgagccagagcatggcaaaacggaaatggataagatcgcgccggatgccgtggagttcaagttgttcaacaaggccaccatggaccgcggagacctggtggccttcctcttcatcatgggagtgagcgccacggaggacgcactgcatgcggagctgcgctacctcaagctcacgagcgacctcatcacgccggcgcaggccgtcttcgtgtggatggagatgaaggacgacgaaaaggatgaagacgctatcctcaagcgcgcgttcatgttctttgacaaagacggcaacggcgagatctctgggcaggagctgcggcaggccatgggcgacgtgggcaacatgctcacgggggccgagatcgacgagttcatggagctgatggaccgcaacggtgacggtgtggtgggctacaacgagttctttgaggtgctcacgaagcagaccgacctgggccaggtgctcaacgacgtcaagaagctggacaaggacatccaggacatgttcaattcttag

SEQ ID NO: 126 - DNA, 1227 bp, Chlamydomonas reinhardtii
atgtttggacgttttcgaggcttcagggaccgcctcaaaaagcgtggccatcatgtcgaagaagagttgacgctagaaaactcaaatttgacatcggcacaaatagcgacggccctgaaggccctcaaaattctagggctcgagcccaagaagcagcagctgaacaagcaggacttcatcgtgtttctgtatgctatgggcctgaaccccacggacgacatcattgactccaaagtccgcgccttcaaactgcaccacaagaagacattcacgtttgggcagctggcgcacgtatggtattccatgctgcaggacctgacggatgaggacgagattctcaaacgcgccttccagttctttgacaaggacggcaacggcgagatcagcgtgcaggagttgaagaccacgatgcacgagctgggcgacttgctgagtgaggaggagatcgcggccttcatggcgatcatggatgtcaacaacgacggagtgattgggtacacggagttcctggccacgctgaagacgcaggcgcccgagctgtcgggcgacaaccacaagctcaagacggcaatggagggagacaggagtgtcgcgggcggcctcatgcgcgccgacgcccgccactatgaagacccgggcctgccgctggcgggcgccgggcccagcagcccacacgacacactgctagcggcggcggcggcgctgtcgccgtcagcccaccactcacccgccgggacacacaccgggctcgcgcatccggcgaaccaggcgcacccgcagcagcagcagcagcagcagcagcagcagcagcagcagcagagcctcaaccggcgacaccatcccgaactagaagaggcggctgtgcaaggcggccgggagggaggcctcaaccgcgggagcgagggcgagggcgtggggataccggaaccgtccgtagcggcggggatagggccgggcgcggtcggcgccagcaccggccggggcagcggcagcggcgaaggcagtgcgggcggcgcagggccaggctcgccgcggcgacaggcgtcgctgcgggaggcacaagcggcagaggcgcgaggcacagcggcgacgacagcggcgatggcggcggcgctgcagcggccgagcagcagcagtacgcgggacggggcggcgcttccgccgtcgtcaccgccgggcgtaggcgctgcgccgctggagcgcagtgggtccaaccacagcaggtag

SEQ ID NO: 127 - DNA, 3321 bp, Chlamydomonas reinhardtii
atggagaaatatgagttcctcagccggacaggagagggggcgtatgggtcggtatggcgtgcccgggacaagaacacgggcatgatggtggctgtgaagaagatgaaggacgtgcctaccacagaagaggaaggggaaatcgccatgcgggaggtccgtgtgctgcagctggcgaaacacgtgaacatcgtcaacctgctggaggcatataagagtcagagtgggcgcctgtaccttgtattcgagtatgtggagcgcacgctacttcaagagctgaaagccaaccgcggcggcatgccgcccgctgctgtcaagtcgttgacatggcagctgctgcagtcgctctcatacctgcaccggaagcagatcattcatcgagatgtcaagccgtcaaatatcctgattacggagagcggcgtcctgaagatttgcgacttcggatttgcgcgcgccatgaccagctcctccgcggacccagcctacaccacgtacgtggtcacgcgctggtaccgcgcgccggaagtgcttgtgggcgacaactacgggccgcctgtggacgtgtgggcgctgggctgcatcttcgctgagatgttggcgggccggccactgttcccgggcaagaatcatcacgaccagctgtggctaattctcaagtgcctgggcaccatgacggagcggcagctggagctgctggactcggacccgcagtttgcgtgcttcaggcttcccacgcaatcggagatcgagccgctggagcacaggctgagcgcactgagtggaccggcgatgcagtttttacgggcgtgccttaacccggaccccaagcagcgcgccaccgcagacgagctgttggccatgccgtacttttcgggtgtcacggacgtgctgccggtggacgacctcatggcatacccggacgccgacctgcgcgcaaagctggaaaaggcggtggcgcaagacgccgcggccgctgcagcagcagcgcagcgggagtccttgctgttgatgcccagcaccagcaagcgcggggtgctggcgcccactaacagcaagcagcacatgaacccgcacatgaacggccaggccgtgtcacccggccgcaatggctcgggtttgccgctggtgcaccaccagcagcagcagcagccgctgctccagccgcacagcagccagcccatggtgggtccgctcccatccaaggccgccagtgtgcagcagctgtcggcagtgcacatgacggaagcgcggccgccgctgcagcggtacattacggcgccggcgggcagcatcgccagcaaggtcatgtcgcagccgccgccgctgcagccgctgtcgcaacacggcggctactcgcaggtgccgcagccgcagcagcgctcccgcccgagctcgggtggcggtaacaacagccagcagccttcgccgtcgggcagcagcacaagcaaggcgtcgtcgcagcagcaggtggggccaccggggccggtgcgggatgagcgtgaccgcgagcgcgaacgggcgccggcgccgtccgggaacgcgctggtgccctcaggcatgaacggcatggggcttggcagcggactgcccatgcggcccacgcgcggcacgtggcgattcagcggggacggcgaggcgggtctgcctcccaccatcactcgccagctgtcgggcacggtgaatttccagacctacagcggtgcagcagctggcggcgggggcgcggcaatggagcaggggcgcggggggccggaccacgtgacgccctccctgcgtgcaccgcagcagcgcaccacgtggaatggcgctgcgtcagctgcgcagccgtcgcaacgaagcggagccagcaacggcggaggcagcaacaacaacagtaccagcggtcaggaccagggccagtcgcgcagctcgagcatgaacgggcaggagcagggcagcagcactgctgcgcaccgcaaggcgcacagcctcgcgggcaacgaggggctgcacgtgaacggcgggggcggcggtagcgcgacgctgcgcaacggcgtcgcgcctggcggtctgactgggctccaaggccgcagcctggccccggcgccagctagctccagcgggcagtcacaggccacgcacccgggcttcccatccgcaaacgcagctgtgcggctcagcccctcgccgccgcccggtagctatggtggcccgctgcggtccaccaactcagcgtcgctggtgcagccagccgcgcaggcctcacagggtcgcggcagccacgacggcatgggcaacggcccctcgggtcagctgctactgggcccgtctgtccacggcatctccatcgtgtctggcggtgggggcggcggcaagacatccaacagcggctttctgccgcagcccgggtatcccgggagcacctccagcatgcacgccggcggcctgctggagccggaggcgtcggactcgagctgctacgcagatgcctctgcctacctgaacgacggccggcgtgcgtcagacacagtgctgtacgcggcggccgccctaaaagaggcgaagcataggcttgacaaggcgtcaaacatgatctcagggaccagtcggccgccagggctgctggacggcgtgccggtcgctaacggcggggcggtgggcggcacacttgacgggggcagccgcagcgtggggctaggggtgctgcgcgcgccttcgtttggcaggacgtctgggccgcccacgggcattccgaacggcccgccgtctccagacaccgtcttgccatccaacctgccgccgctgatgggcggcacgccgcgccgcatctcggcgcccgagtcctccaccacgtcgggagcgctggcggcgttgaacaacgctaccaacggcggcggcaccggcgcgttaggcgcaggcagtggcagcaacagtagccgcgcgctcatgggcagcagccacccaccgagcggtggcggctacctgcagcggcacaacaacaagcaacaacatcagcagagccagcagcagcaggcaaacctgcatggccaagcattggcgcagctgccgagcatgggcagcggcgatagcgacgagggggcccaggctgccaacattagtagcaatggtgcctcccatgggaccttcctgcctgcgctggaggtcgggaagccgggcagccgcataccgtctgcatccctggggtccacgtccggtgtgggcgtgggccgtcggccaagcaagggctcgctgcgctctgtgggcccggaagcggcccactgcaagcgtgaggaggccatgaaggcgcttgccctggaggcggtgccggaggccggcgttttatga

SEQ ID NO: 128 - DNA, 1359 bp, Chlamydomonas reinhardtii
atgtcggccaatcgtcgcagcactaatagtaattctgcatctggggcgcggaacggtgctcgaacgagcagctccgcggacaatgtgaagaagtgggtcgcggaggacactcgagaggagggcaaggctgtttttaaagcacacgtcaaggagacaagcaacttggatgttctatctcggtgcaagaagctcaacgagcttttaagcagcgacgtgctcaaaggcaaaggggactccaaggagcagctgaaggagattctgggcattttgcactcgggaccaaagcggccctcctttctggacaaaccgccggtgacggcaactgcaggcaagcggccggtgccggcgcaagcagcgcagcctgttgcagcagggccttctggacaccttgatgcggatgcgctgatgcggctgttggactcggaggacgcggaccaggcggcgagggcgagcccaccttccacctcgcgcaccggacaacctcaaacggcggggccgccagcagaggacgttgacgacctcatcaacctgctcaatgacgcctcgccggcacccggcaacggcgcattgccggtgcagcaaaagcagcagcgggagcgggaggaggccgagcggcagcggagaataaaggaggcgcaggaggaggcggagcggcaccgcaaagccaaggaggaggcggagcggcagtggaaagtgcaggaagaggcagagcgccagcgaaaagcactggaggacgaggctaaggctgaggcgcagcgcatggatcggatgcggcggggcgcagcggtgtgcatccaagctgcctggcgtgggcactgcgctcgccgcctagcagcggtacggaggaagcagcgcgctgaacagcgggcggcagaggtgcttcaagcggcctggcgagcacggggcgctgcgcgggagcatcgtgcgcgccttgccgcggcggcggcgctgcaggcggctgtgcgggcgtggcaggcgcgacgggcgctgcagcggctgcgcgtgcaggagttccggcggcagcacgcggcgcggcttatccagcgggcgtaccgctactaccgctacacacgcggatacacgttggggccgctgagggtgccgccgcagggtggcccgcggcccggctccggatcgggtgtggacggcgcggccttgctggcgaagcagctgcggctgcgcagcgcggtggacgcacggctagcgcccgagacgccacaacaagcgcagggggacgacgatgcctcgcagcaccgcacagtggccacgcaccgtgagcgcgtgcggcaggacccggcagccagctgccgcccacgcaacgtgtgtcgtgcggcggtgacggcggagggcggccgttga

SEQ ID NO: 129 - DNA, 660 bp, Chlamydomonas reinhardtii
atgccgctagtatatgtaagcgtatgccagggctctgtggcgctcgcggagtatgcgggcttccaaggcaactttgcggtggttgctcgcgattatctggacaaagccaccaagctggagggcaagagccgatacgaggttgatggccactccctgaacttcctcaatcgcggcggattcacctatctggtgatagccagtgtggacagcggcgtggcgctgccctccgccttcctggacaaagtggaggcagagttccgggccaagtacggcgccgggctgcagctgggcgcggcggccggctcgctgaacgccacattcggcaagcagcttaagcagttgacggagaacgccacgcagcacccggaggagttctccaaggtcgcggccgtgcaaaagaaggttgacgaggcgaaggcggtcatggttgacaacatcgacgcggttttgaagcgcggcgagaagctggagcagatacaggagaagaccgaggacctcatggcggaggccgaccgcttccgcgacggcgcggtgcgcgtgaagcggaagctgtggtggcagaactgcaagatgaagatcgtggtggcccttgcggtcatcctgctggcggtggtcatcttcctgctggtctgcttctcgggcggcaactgcctcaagtga

SEQ ID NO: 130 - DNA, 900 bp, Chlamydomonas reinhardtii
atgataagatttgttcactgggttcgcaccaacggcggctggcgcttcttcgtgcgcctcttgttccagggctaccagggcggggccgctggcgtgggcccgttcaggtggcagtggggcccagcagcgggacagcaggcgggtcagcagggtgctgggcgacccggcgccagtcgccgccgcgtgacactggaggaggttgcagacgcgctagctaagctgcccacggaggcatacatgacgccgcagcagatggcggcactgtccgtgcacgagcttaaggcgctgctgcacggccgcggcctggagccggtcaagtgcctggagaagggcgagctggtgcggcagctgctggagcacggcggcagcagcgccgactcgtgcagcatatgctgcgaggagtatgcccagcaggcgtcaggagccgctgctgagacggcgcagatgccagcggcaggaggagcggccgcagcaggagcaggcgcaggagcagtagaggcggcggcggagctggggcatggaggcgccggatcaactgagtgggtgacggacgtggcggagcggaatgaggctggggccgaggaccatagagcgtccgtggctagcgcggcaggggcagaggctgggcccgcgtcccactgcggcgcgggcggtggtggcgccagcgctggcgagcacgccgtcccagccaatagcggctgccgagccactgggggcatcgcatctgatgctgcagcggaggcggaggacgacgcgcctgttgtgctgcgcgtgctgcggtgtgggcaccgtttccacgtggagtgcgtggacaagtggttcctcagtgccactgactacacgagggaaccggcatgcccgctgtgcaatgcaccgctcatccttcctctccggcaatag

SEQ ID NO: 131 - DNA, 963 bp, Chlamydomonas reinhardtii
atggcgcgattgcaagcaagctttgaagccggagcgagccgcagcggcgcgctggctagcacttcccagcgacttgttcgcagtcctgtactcacagcagaagcaccagcaggagcgcgcttggcactcagggcgcttgcctgcggcccgagcacccacatctgcccgcggctgctggcagcccacagcgctgcggcctgcggcgcctgctccccaacccgcagctgcacacacgccgcggcagagccgctaggccagacccgcaccagcggcctcaggtgtgctgtagtagctagcgcgcagcggcgaggcggcggcggcggccggggcagcaagtgggacagtgatgaggagctggaggaggacctgggcggcctgcgcttctccaagcgcagcggcatgtggcggctgcagtacaacaagtacggggcagaggtccgcgaggacgaggcgtggaagctggcgctgccgctgctgggcggcctggtgctggccaccacactcataggcccgctcatcatcggcgtggccttcacggcggtggctgtgggcgcggcgctgtccgcgggcgcgctgttcacctcgctgttcctgcccttcttcctgctcatcggctttggcgcgctgttctggggcggcgtcaccttctccgccttcgccacgctgggcgccgcgctcatcatcaagccgctcatgtcgctgatggtggccggtgcgggtctgggcatgggtgccctggctgtgggcgccttcctcaagcccgcgtccagccgggccaaagcgagctatgaggagaaggctgcggcggccaagtccggggccaagcagcagggcgatgtgatcgaggtggagccggaggtggaccccgaggtggacaggcagctgcgcgagtttgacgagctgctgatggatcgggagcagcagcgccgcaagaccgaccgcttccggcagggcggccgctga

SEQ ID NO: 132 - DNA, 5856 bp, Chlamydomonas reinhardtii
atgccccagctgacacgcgcacggcctgctgctcacgtaggcaatacgaacgacggttcgcaacaggcagccggggcggctggcgcagccgcggccggtgccccagaccccaacgaccccgacgcagcggcggcacagctgggcccctccgcgtctcgcgcgggatctcaggcggggtcacagggcggggcgccgggggccggcacggagggcggtgccggcgcagcccccggcgcgggcggtcagcctcagggtccgggcatcatgcagaaggaggagcgggacgcactgcaggtggccatggtgtcctacgacaacagctacaagctacaagaggaggcgccggccgtcaccgccgccatcatcctgcacttcgacaccggccgcatcacgggcgcgccggcgccgctgccgtctcgcctgacggcgcagcacgagggccgcttcgctcgtgaggagctgggtctgtaccgggagaaccaggccttgctggcggagatggctggcggcaacgcggctgcgggcgggcagcaggtggccatcatggctcagcggcaggcggtgcgggcgcaggaggtgcagacgcagcagctgcaggtgggcgcactccccacactcacggaggagccggaggggcaggaggggcagctggcgcagccgccactgggggagcagccgcagcagtctccgctgccaccgggcgctggctcacctccgcacgggcagcagctgcagccggggcaacagccgcccatgacgccaggaggacccacgctcccgatgccgcctgggcccggtggctcgcctcccatcatggcggcggcgcagctgccgttgtcgcccggggccgaggcggcggccattgccgcagccggcggcgccctcacgcccgagcagcaggcggcgatgcagctgcaccaccagcagcaacagcagttggcggcgcagggcattctgccgcctggcgcgcagggcgacccggctgcaatggcggcgatgatggcggcaggaggtggcggcggcggcgttgatcccatggcgatggccgtggcggctgctgctgcgggcgctccggccaccaccgccattcaggacccgctgtttgcataccagtggctggatgagaacggcctgatggtgtaccgcgacaaggagcgacccgcccggcgctatgaccaggacaaggagatgacgcggacgtatgtgcggcggccggtggtggacgcggtggctggcgcgggcggtcgtggcggtcgcggcgagtcgcggctgtaccggctggacatcgagctggggcggctggagttcggggtgcaccccgccatgagccaggaggacctgctggctgcccggctgatggccctgttccgcgagtacaagaagcgcgaggcggtggggctggtgctgttctacgccggccgcctggccgcgctggaggacagcctgctgggcgcgcgcgagaagctgtttgcgctgcaggccacggaggcggccgctgacgatgtgctggacgcatacgcactgctgggcaagattgagcgggaggttgcggagctgcgtcagctcaaggaggaggaggaggcgctgctgactcgcaccgtgcgagccatggagcgccagttcgaggccctgcgcggcattcggcagcagcagggctacgcgctaacaaacctggagctcacggtgctcacacgcccgccgctggagatgagctggaagcagggcgtgctgacccgtgagcggctggacgtgctgctggtgacggcggagctggaggacattgcgggcctgcctcgcttcccggaccccctgcccgtgcccgacctggcagacttgcccctgccccgagtcaacgccgccgggctccccgccgccgccgggggcggctttcccggcgccttttcgggcgccccgggccccttcggggcgcccctggcgggctatggggcgctgatgtcgggtgggcagtcggctgcggctgcggccatggcggcgggggagggctacacgttccggctccggcgagtggagtccatgtgcgccgcgcacagcgcgctgctggcggaggcggtggcgcggctggatgcactcaagaaccgcccctccgccgaccccgaggacccggtgctcaaggcgctggaggaccaggtggcgctgctggggcgggcgccgcggcgtgtggccatgatggcagaggacagcctggagctgcagcgccgagccaccgagatggtcaaggcggggcaggtgcacgtgagccgtctgccgcacctggtgccggtgctcaccatcaaccccaccggcgctgcaggggggcacctgccgcccgcagcccagcagcagctggcgtacatgcagctgcagcagcaggggcagcagcaggggcagcagatggtcatgacgccgcaggggctgatgccggcgccggggcagcagcagcagcagctgggcccggggcagcagctgccgggagccgggccgcaggggcagcacatgggcgggccgatgggcaatcagcccaagacggtggggaaacagggcagcaagggcaggtactacgtgaagctgttcgtgaaccacaagttcgtggaccagtcggatgtggccacactggccgagaacttctcgggcgacttcaaggacctgttcagcgtgcaagtgagccacttccccgagtccatcctggtgcagctgtatgagcgacacgcgctgagggactacttcgtggctcaggtatacgtggcggtgccgggcgtgtccggcacgccacacgtggacgccacgccgcgcccctaccagttcacctcgctcaccgctttccgcacccgcggccccaacaccagcaaccccaacggcggcggcctgtccggcgccatgccgctcatgccctccgacaccggccggcccgacggcgcgcccggcgccttcgccaccgtgttccccgccggcacgctgtacgtgcggtgcggctgggtgtcgcagcgggtggcggcgggcgcgagcctggaggagagggtggtgcccaaggccatgaccacgtacgacaacccgctggcggaccgggggcgggaggaggggccgctgggcacgtgggcggggcagccgggcagcggcgtggtgggcgcgccggacattgagagcgggcgcagcctcatgccgccgctgccgtccgtgcccgtggaccgcatgctgcgccgcgccgcggagcgcatcggcggcaaggccaaccgcgcccagatcatgcggtggctggcggacaacgtgatcgaccccaacgacccgcgcaacgccccgctgctggagctgctaaagacgcacgaggccgccagcggggcgctgggcgacctgttcaggctggacatattcccagacgtggccatgaaggacgaccgtgtggcggacaaacgcatgagtgtgctggcgcggcgctggcaggccggcatctaccgcgcccccgacaagaacctgctcaagggcgtgcgctccgtgcccctgcgcgcccccctgacctccgaggagacgtcgcagctggacagccagtacctggaccagctggcgctgctggaggaggcggcggacggcacgcagctggggctggcgcgggtcatgatggcgcggcacgagaaggccatgcaggtgcagatcggcgctcggctgaccaacgcaatcaaggagcgcgaggagcgcatccgcgccttcgccatccgagtgcgcgccgccgcggcccggctggcgggcggccgaaccatggcccgccgcttccggaccgaggacgtggtgaacgacgcgccgctgccgcagttcaagctggagctgggggccattgcgcagctgctggcgccgcggcggccgctcaagaggtccaagaagctggtcaagtcgctgatgacgtcggtgccgcgcgagacgcagctcatggtcaccatacagcgcgcagccagcctgcccgcgcgcatggccagatcggccgtgggcggcacagacgacaagcggctgcgacgcggcgcgggcgtggaccggcggagaggcgggcgggcgggcggcgacggcggcgacgagggcggaggcggtggcggcggcctgccgtcgggggcgccggaccggctgtcacagcagcgcaactgctttgtggaggtgcgcttccgcagcctgtcgcagcgcaccatcgccgtgccgggcgagttccccatcttcaacgaggagatcgacctggacgtgttccgggacgacggccgcgacacgcagcaggccggccccgaggacggctcggcgctggagccgtcccccagcgcgctgcaggagaactccgacctcatcaccttcaacgtgttcgatgagatcatcgtggagccctcagagccaattacgctgcgcaggagggacgcggagatcagcgacccggtgcgtctgccggagcgcgagcggcgcttcctgggctgcgtgcgggtgccgctgagcgccgtgtaccagatgcaggtgctggagggcaccttcaagctggaggcgccgccagtggtgctgggatacgtgcagaccagccagcggcccagcaccgtcagcatctacatgacgctgcggccgcggctggccgcccccgccggtgagatggacgagcgcatcacctcgggcgagcaagagcaggtcaaccggcacgcacaacggtggcgggcggcgctgctggggcgggccgagtgccgctcgcgagtcatcaaggtgatggctgtagacgcagacggcgcggcggtgctggtgtgccgctacgtggcgcccacactgctgccgccctcgctggccgtgaacgtggcggcgggcggcgcggcggtggcggcgggcggggtggagatgctcatgctcaagctggccagattcgtggcgcacgtgccgtacatggaggacagcggcctgcacaagcggcgcaacgacatctggaccagcagcagcgagctgctgcacctggcgggcggcgacttcgaggagcacgcccacctgctggcgggctacttcctgcagctggggctgcaggcgttcgtggtggccggcacgtcgctgtgcggcgctcgcagcatgttcgtgctcaccaccggccaggccgccgcaccgccggggcagccgcaggcgccgccgccgcccctgcatctgaacgcggagctgctgcggctgtggaaccccatcaccggcagcgtggtgtcggtgaaggaccccaccggggaaatgcgcgaggtgggccagctgtacgacggctccaacatctgggccaacacgcagcccacggggcggccgtgggagatgaactggaacctcaccagcggccgcgactggacaacgccgctgtacgaggagcttgagaagcagttctatgaggagctggaggggcgcgtggagaaaaaggtggaggaggccctcagccaggctcgtgccgcgggcgccttcgtgaccaagcccgacaacagggtgtcccgactgctgaagaacctgctgagggagatgcccaagaccagcgaggccatcgcggccgcctctctggccgccagcgcggcgctggcggaggcggcgggcaaggggccgctggaggcgccgcagcacttgggcgagcgacacaacctcatcaccggcctgcaggccagccacaacgagcgcatccggcgcgagtccaaggccgaggcggtacacggccacgtgcttgcgctgcccttcagcgactcctacctggaggcggtggcggacgcagtactcaacacgggcatccaccggattgcggacgagcgggtgaagttcagcaccgccgtgttcgtggagccgctgggcgcgtccttcgtgtgctgcgtctggatctatgtggcggcgattcgctcgtga

SEQ ID NO: 133 - DNA, 2349 bp, Chlamydomonas reinhardtii
atgagctacgggggcacggaggaggatgacctttatggaggatatgatgagcaatcgaacccgcttgcgggctcgggtggtgccgcatttaaggcacttggggccgatggagctcctccaggcaccgccatgatggggccgcctggcacggccatgaagagcttcgtgccaggcacggctatgcggggcggcacggcgatgcagcaggaccccagcctggcgcggcctatgacctcgaaccggggtgctggcttcacgtcggcgcctaacaagaagtttgaccccctcaatcgctcaatggggtcgacactgggctcgtcggggggtggcgcaatgctggtggctcgcaagggtgacaccagcccggaggagcaggcgcgcgggatggagaagacggtgcatgagctgcttgagaagagcgcggcggacgcggctaagaatgacatcaactcggccctggagaacgccatggaggcgaagaagaatgagcgaaagctgtgccgcttccgggaacagaacaacatggcggaccagatcaacctggagctgatgtacgccgtggacttcaacctggcacacatgtaccacatgaacaagaactacagcgaggcgctgaacctgtacacagccatcgtgcgcaacaagaacttcccgcagtcgggttggctgcgcgtcaacatgggcaacatccacttcgagcagaagaagtacccctccgccatcaagatgtaccgcatggcgttggaccagatcagcgccaccgccaaggaggtccgcttcaagatcatgcgcaacatcgggctgtcgttcgtgcgcatgggccagtaccccgacgcgctgcagtccttcgccacggtcatggacaacgtgcccgaccaccagaccggctacaacctggtcatgtgcaactacgcgctgagcgaccgcgagggcatgaagaacgccttcatcaagctgctcaaggtgagcccacccagcgagatggatgacgatgacgacgacgaccccatgggcgatgacgacatgcaagtgatgaccatggatgacgggctgaaggacgagatgcgcaagcgcaacaccatcatcacgcgcctcattgtcaaggccgcgcagctcatctccgagaaggtggatcgcgccaacggctttgagggcggcttcatgtggtgctgcgagcagctgcgcgacgcgggctacaccaagctggccaacgaggtggagctggccaaggcgacccggttcatggggcaaaagcagtttgacaaagccgtgggcgtgttcaaggactttgagaagaaggagccgcgcgtcaaggcgcgcgccgccaccaacctggcgttcctgtacttcctggagggcgagaccgaccaggccgacaagtacagcgagatggcgctcaagagcgaccgctacaacgcacgagcctacgtcaacaagggatgcgtgctggtggagcgcggcgatctggagggagcgcgaagcctgttcaacgaggctgccggcatcgacccctactgcgtggaggccatctacaacctgggcctggtgagccagcgcctgaacgagctgccgtacgcgctggcggcgttcaagaagctgcacaacatggtgcccgacaacgtggaggtcatccaccagatcgccaccacgtacgacatgatgggcgacttcaagaacgcggtcaagtggtttgagctgctcacctcgctggtcagcaacgaccccggcgtgctggcgcgactgggagccatccacgccaggttcgacgacgaggccaaggcgctgcactactaccaggagtcgcaccgcgtgtacccggtgaacatggacgtcatctcctggctgggcgcctaccatgtcaaatcggaggtgtacgagaaggccatgcccttctttgacctggcctccaagatccagccgcaggaggtcaagtgggcgctcatggtggcgtcctgctaccgccgcaccaacaacctgcccgccgcgctgggcaagtacaagcaaatccacacgcagcaccccgacaacgttgagtgcctgcgctacctggtgcacctgtgctccgagctgggccgccgcgccgaggccgccgagtacatgaccaagctcaaaaaggcggagaaggcggcggtgcccgaggcaacgacagcggcggcgcccgccgcggccgcagctggcagtggcatgggtggcatgggcggcctggacgacgacattggcagcagcgcggtgtcggcgcagaaccgcggcaagaagatgctggtcaaagagcacatgggtggcggcggtggcaaggacaacgacgactggggaaacgagcagcttggggacgacctgctgcccatgtaa

SEQ ID NO: 134 - DNA, 11601 bp, Chlamydomonas reinhardtii
atgagggtgaatgccggcgacggcagagctgccgccccgatcccggagaaaacggtgctcttgaagggcccactccaggaccgggtgatagcatggtcgctcgacgccatcgaaaacggcgaggcatggcaaaaacagctccagccgctccccgacacctttgagacggcggaggagtgggccggcctgctgcagccctttttgctgctggagatgcaggcggggctgcggcaggcgctggagcagctgggctccgccaagtggctgccgctggacggcgtgccggagctgcgacgagataacgaccaacgcggcggcggcggcggtttgattggcggcgaggaagatggcttgggcggcttcgcgccgccgactttatgcaaggccactgtcaacttcaccgtgcgcgggcaggaccgaagcggcgccggagcaggcgactggcgcgccgcgcgtgccgccaccgcggcggcggcggcttcacaagcgggaggtggcggctgggtgcacaagaagccgccgccactcaagcccactgacatcgtattgctggtcaacgcccgggtaccggacctggcttcgctccggcgcagcgacgtgctgtgggtgctgggcgtggtgcagcggtcgcaacgcggcatcgtgggggacgccgaggacgaggaggacggaggcggcggtttcttccgcgcggcggtgcatgtggccgcgggcagcagactggaggcggcactggccggcggaggcgccgccgcgtctggcggcggcttggcggctgcggcgcgggagtggtacgcggtgccggtgggcagcatcgccacagacgagcgcgtgtggaatgcgcttctcttcctgggcccgctcccggtggcaggcagcggcactgccctgtcgcgtctgttgccgccaccgccgcagccatgcatgctgcagctactgctcggcgacggcaggagcagcagtagcagcagcgccggcgctggcttcggtggaggcagtagcactgtctacgtggaatccatccgtgccgctgctcggcactacgcgagcaccgtgcggcggctcaatccctcgcagcaggacgcggtcgtgcgtgcggctgtggccttggcggcccgttccccagccaatgccattgccaatgttgaagacgcaggcagcggcagtggcagtagcagctgcggcagtagcggcggcggcggcggccgcgcggagctgcagctggtgcagggtccgccgggcacgggcaagacctccaccacggccgcgcagctgtcggttctggcggcagtggggaggccgggcactgcgctgctggcaactgcgcccaccaacgccgccgtgggcgagacagcctccaggtttgtgaagctggtggcggcgggcggtcagcagtttgcggacagcgaggctgcggcggagctgcgccgccacggtctgcgcgtggagccgccgctcctacccggcgacatcgtgctactgggctcgggcgaccgactggacctgaccggcagccccgagctgctggccgtgttcctgcaggccagggccaagcggctgtctgcggcgctggccacctggtccctgacggtactcgacatgcggcggctgctcgcctacccctgccaggtgcatgtggacacattgcgcgcggcggaggcagccaccgccgccgccgccgcaccgggtgcattccgacagccgccgccgccaccgcagccgccgccgccccgaagcgtgggagggtttctcaagcagcggctgccgccgctgctgcgcgagctggcggccgcggccagatgcctactcgcagacctgccgtctgcggcctgggtggcgggcagcagcagcaacaacaacaacaatagcaggggcaacagcactgggatcgccgctgtcggtgggcgtggcgccgccaatggtagcttggcgccggcggccgcatatgccgcgcgagccgacaccatcgtggcgaatcgcgacgcggtgcagggcctggtagacgcgtgcgcccatctggcagcggggctggcggcggcgagcgctgcggaggcgtcacgtgcggctgaggaggtggagcggcgtggcggcgccgctagcggcgccgacacagatgccggcgggcccctcctatcgggctccgccgccctggcgtcctccatgctcgacctgacagccgccatggaacgtgcacgccgcgcactcgcgtcgaatgtgcccatgcccaacgcggcgcgctcgggcggcgggaacatcttcgggtactgcctctcaaaggcacgcgccatcttcgccacggtggcggcggtggggtcggcgcgcatggccgccgccccgcccgtggaggcggcggtggtggatgaggccgcccagctgccggaggcgcacctggctgtgccgctggcgctgtgtggcggcgggtcgctggcgctgctggtgctggtgggcgacccccagcagctgcccgccacagtgctgtcgcaggtggctcaggccaggttgtacggccgcagcgcctttgagcgcctgcagcggtgccaaggctggcccgcgctgctgctggacacgcagtaccgcatgcacccggccatcagcacctggccgcgggaccgcttctacggcggcagggtggtggacgggcccaacgtgaccgcccccgcgtacgccggcgtggcgcagctgctggggctggcctgggggcccctggtggtgctggacgtgagcagtggggcggaggagcgggaggcctacaatgacggcactggcgaggaggacgccggcggcggtggtggcggcggcggcggcggcggcaaaggcaccagctggcgcaacccgcacgaggccgcggtggcggcggcggtggtgcggcaggtggcggcagcgtggcgagcgctgcgcagcaacagcaataccgtgagtatgaccggtgctggcgccgcgaccaatggtgctggtggtgtcgcggccgctgcgacggcggaggccctggcgggcctgacggcggcgcgccggtcgctctccatcggcgtcatttcgccgtacagggcccaggtggacctcatcacctccaagctggagcgactggacatcgaccttgcgttgcaggcggatgcggaggcagaggcacaggcggcggcagaggcgggaggggcggaggcgggcacaggcgggccgccagccgcgccatcaggtggtggcggcgtgtcggtcgcggtgcgctccgtggacgggttccagggccaggagaaggacgtgatcgtgctgagcctggtgcgcgccaacaccgccggctatgtgggcttcacggacgacgcacgccgcctcaacgtggccgccacacgcgcccgccacggcctggtggtgctggtgcacgccgccacactgcgccaccgcagcgagctgctgcgtgcgttcctggaagatgcaaggcagcgcggcgtgctgctgtctgccagcgaccagccgcagatggcgcccgcgttccgggctgtgcaggcggagcagcggcggtgcgccgctatcgtgcgcggcagggcgccgtgggacgaagcgccatggaaggtgatctacacggaccgctactgcagctcctgcatgcagctgcagcccaaggcgtggcgcgtgcgcatgatcgatgcggtgctggagctggcgcacgggcgcttcccgcggcggcaggtgccgctggcggcggtgcggcccgagttggccgccctgctgcgcggccaacggctgcagggcgggcggctggtgctgctgtggtcggtgcggctggagaggcatcagcagcagcccgtgcgccagggcggcagatgggtgcaagcgctgcagctgtgggacgtgctacggctgctgcccgggcaggatgcggagctgggtgcggcggtacgacgggtggaggccgagatggccacctacacagacgaacacctggctgcgttgcggctgggcgagccggggcccgacggcctcatccggccgcgcctgatctgcaccgggcccgacctgccctttgcccgcttcgttggggccgcagcagccgcccctggcggggccgccacctctgggacagcagcagcggggcgccacgccggcgtggggccccggggtgcagcagccgcgggcgctggcgacgatgctgacagtgccggtgtggacgcgcagcaggagcagcaagggccggacacgcacagccggctgtacgtgatggatgcgctgcacgcgcggcagctcgccaccagcgaccaggcgggcgcgctggcggcgatgttcaagaccagtgtcatcctgtcgcgggtgctgctttacgaggaggccttcgcgcggctgcacggcggcggtggacgtgatgaggcggagggtgggcagcagcagggcagcagtggcagcagcggcagcagcgcggccgcggccgccggcagcaaggtgcggcagttgatcgtgacgctgagcccccgcctcgcgagctccactgccacctacctgcgcaagtgcacggcccagttccagggcctgcagctggccgcgacagcagccgaagcgctcgatgattcggcagacgctggaggcggcggagcagatgccggcggcgggggcgaggctggcggcgggggcgaggctggcggcgggggcctgctgcagcttagtgacgacacggacgcggcacgcatgtacggcgacatgcccggcagcctggcggaggtgtcggacgccgcctgcccgctggtgctggacctgcgccgcttcctcctcatgctggacgccgggctgcctgacccattcgcggcggcacagcggcgtcgggcggcggcggcggcggcccggcgtcgggcggcaacggcaggtgctggcggtggcagcagggccgcgccggcgccggctcagcaggcgaaggcgccggcggcgcggggtagcgggcagcggtcgcacgaggatgatgatgacgaggacgttcctgacacctgggacgttgacagcgaggacggcgctgttgggctcggtgccgcgggcggcggtctgggtgcggccgtaggtcagcagcagtgcgaggcggcggcggaggcggtggaggtggactatgagcgctttgcggcggcgtactggccgcgattcagtgccgagctgcgcaagggcttcaaagagccggctctggtgtggcgcgaggtgcagacgcacatcaagggcagcctggctgcggtgctgccggaggcctggggcggcggcggcggccggctgtcgcaggaggcgtatgtgggcatggcggattcacgcgccggcgcgaacctaagcgccgagcagcgcgagtgcatctacaaactgttcaagcagtatgagcggcagaaggaggcgcagggcgagtttgacctgggcgacctcaccgcacacctgcacacggcgcttggcggcggcggcagcaggcgtgcccaggcggcggcggcgctggcggcggcccggcaattccgatttgtgtacgtggacgaggttcaggacctcacgccggcccaggtggcactgttcaagtacgtgtgcgcccgccccgccgacgggctgctgctggcaggcgacacggcgcagaccatcgccaagggcgtggcgttcaggttcgaggcgctgaaggacctattctacctgtggatgctgaggggcggccctggcgggcaggggccgcccgcgccgctgttcgggccgggacggccggtggccccgctgccgctgggcgtcaaggtgcccgaggtgacgccgctgctggagaacttccgcacgcacgccgccatctcgcgactggcgcacttcggcgtgctggagccgctgctggccttgttccccgaggcgctggaccgactgccgccagagacctccaagctccggggcccgaagcctctgttcctgctgccctcctgcggccggctggaggacctgctcctgccagacactgctgctgggggcagtggcccggccgccgccgccgctgcccgttcgggcgggggcgccaatggtgggggtggcggagaccgcggctcgaccgcagccgcagcggcggcggcggctcacgaggtggtggtgctggtgccgaccgaggcggccaagcaggcggtgcgccggcagctggggtgcggcgacggcggtgcagggcagcaggtgctggtgctaacggcactggagagcaagggcctcgagttcaaggttgtgctgctgtacaacttcttcagctgctcggctctgcagcccgcctcacgatggcggctgctctaccgcctgctggtgcagcccgagttcggcggccggctgcgacccgagcaagtggagccgggaggggagttcgcggcgcccagcttcgacctgcgggttcacagcgtgttggcctcggtgctcaaggaggcgtacgtggctgtgacgcgcgcgcggctggatgtggcgattctggaggaggaccccgcagcggcggagcccgtgcgcgcgctgtggggaaagcaggggatggatctggtggacgagcgagcgcaggcggacgacgcggtactggtccggctgcggcggcagatggagccggaggagttgcggcagcgcgcggcggacctgttcggggtgggcaactaccgcgacgcatcggcgctgtttggtcgcctgggcgacacggcaaacaagctgttctgtgatgcccagctggtcaaacaagacgccgtgcgcgctcacaacgaaggcagagccaaggctgcagagcggctgcacgcgaccgcggcgcagctcttcatgcagtgcgggaggtacgcccaggcggcggagcagttcggggcggcgggactgtggggcgaggcgggagacgtgtaccacacccacctgcgggacagcctccaggccgccacctgctacgagcgcgcgggtcgctgggcggacgcggctcgccggcttgtggaggtggcgcccacgggcccggcaggaggaggagatggtggcggcgggccggcgcacctggaccgcaccctggccgcctgcgtcgcagccaaggagttcatgctgggggtggaagccttgcagcgctggagccagcaacccaacctcctgctgccgccgcagcagccgcagcagcaaccgcggccggcagcggcaggggccgccgccgcggctgtggcgcggcgcgcacagctgctgctgccacggctggtgtcgcggggcgcgctgcactggagggacgtggcgggcgggcgcgatgagatgcttcgcttcgtgcagctgctgccgggtggcgagacggcgcagcgccgctggctggaaaggtatcggctgtttgacgagatcctgcggctggacgtcgccgccggccgcttcctgtctgccgctcgcatcatggaggcacaggcggcggcagtgccggcaaccggcggcggtggcgcggtggcggcggaggcgctggggcacgcggtggagctcttcgtcagggccggccgggcggaggaggcggtggcgctgctgctgcgccgcgcgcgcagcgctgtactgtggggcggcgagcggtcggactggccgccgcccaagcggcccggcggcggcggtggaggtggaggcgcagcagcacggcacctggagcaggcgctgcaggtgctgcagcaggacaacgcggggggcaagatggggccggtggccagacgggcctgccagctgcaggcggacgtgctgagcctgctggtcaagtcgggaggtggaggcggaggcagcagcagcggcgagagggcggcggcggtgcacaacaaagccgccgctgctggcgtgcccctgcaggcgacgacaacgctgttggagcagtgggaggactggcgaccgcgtatcggtgcgctcgaggcaagcgcaggcggcagcggctgtggcggcgcagcggcgctggcgcggctgtgcctgctgcggcgcctgtgttatgaagccgtggaacaggcggcggcggtaacggcgcagcagcagaagcagcagcaggcgcagaagcagcttccctccatcaacagtgctggcaggccagcggcggccgccgccgccgccgccgccgccgccgccgccgccgccgccgccgccgccgaggcgaccaccgcctccattgccgccgccgcggtgcagctgctccgcctgtggggcctgtaccgacgctctctgacagacgtgctgcgtgtgctggagcgggcgcagcagggagttgtcgcagcggccgtagcgcccggtggcggcggcggcgccgctgctgccaggtccgccgctgtcgggtccgcggcttcctcggctgcggctcaggaggcggagctgctggcggcgctgcgggcataccacctggtcgtgcccggaggcgcacacgccgccggtgccgaggcggcggtgtctgccggcggcggagcgggcggcagtggcgccggcgggagcggcgagctgcggctcgagtgctcgcacagcgcggcctgggtgcgcccgccggcggtgcgcgcggcgctgcgcaaggtcctgatctccaggtgcagcctcggcggcggcgtatccaatgctgccgacgccgcggcgccggctgctgctgctgccggcggcggcgacggagcggcaaccgtgacccagcttgtgctcacggaagtgtcgcctgacacgttctacgccggcgcctcgctctactggcgagcggagctggaggcgcggtcggcggcggcgctgagggcgctgctcggcatggcggaggccctgcggcccagctatgagacctacaaggccgtgggggacacggcgctgacaggcggccggcccaacgcgctccttcagagcaaggcttccgaccgcggcggcagcaacaaaggcgccgctagcggcagggtcgcggcagccaacgcggcagccaacgcagcagccggtcgcccacctgctggtctggcagtagcagcagcagtagcagctgctgccgacctggacgccctgctggagcagctgctggccgccaccgtcacggcgccgctgccggcactgctgcgcgctgccagcctgccggcggcgcggcgccacgcgctggaggagctggaggcgcactacctgccgcgcctgctggcggcggcggcggcacggcagccgcggctggtgctgccgctggtgcaccgggcgcaggacctgctgtgggagcggcccgcgcccagccgcctgacactggaagaggtggccagggtggtgctgttgcagccgctgctggcgccgggcttcctgctgcgtgcggcgtacgagggccaggtggactgggaggtggtgtgggcccaggatccacggcgctactccgcctggcagctgctgctggagagcagccgggtggccgaccacgtccgccccctggtggctgcgggcgccgaccccggggacgtcatgggcccagcctgggtggcccgctctggcatcagggcgctgctggacctgcaccgcggcgcctcgctcacgccgcagcagaaggagtggcggccctgggcggcggtgcggccgctgacgtggctggcgctgcttgagcggcactgcctgctggcgctggcggtgctcagcggcggcgccaacaacctggtggcccccagctccctcgtgttcgaccacctcacgcagcctggcgtggcggacctgctgaccctgagcctgcgccacacggcgcgtgaggccgcgccggagcggcgtcaggcgctgtatgccctgctgtgcgaggcgtgcgatgcgctggccagggtgctgaccgcgcccgaggccgtgcgcccggccggccgcgtgcatgacggcagcgcgcgtggcggagctggcggagcaggcggaggcggtggcgcaggtgggagtgccgcagcagggcagcagcagtggccgtcgctgcagcaacagaaggtgcagccgcagaaggcgcgggtcggcggcgggtcggcggcggctggcagcggcgccggcggcgccggtggcggaggcagggacgaggacggcgaggagttgggcatgttcctgcgccgagcggtcgcactgctgttcaccattgccatcaacgtgcgctcgccgccgctgcagcagcagcagcaggcgccacagcatccgtaccagcagcaccagatgcagcagcagcggctgcagcgtgggttcctactgccgcaggagcagcgcctgcagtcataccagcatatgatgcagccaccgccgccgccgcaagcgccggcaccgcagccgccagcgtctcctgcggcctcctgctggcgcgtggcgcgcgcggcggtaggcagtttagggccgccaaacgcaggcggtgccagggcgcccagcggcgctgctgccagcagcggcagcgctcgcggtggcctggcggcttacctgccgctgcttccctacaccctgcgcttcatgctgtcgagcctgaacgccctccacagtcgcagccctgcgctcttctctgagccgtcgctgctggggcccgagttctgcaaggcgctgcagcgaggcggtgacaagccgctgcggctgttccggcgcgccgtggcgccgccgccgggaatggcgtgggcgcgggaccggaacaagggcgtcaacgtcgaggaggtgcgggagctgccgccgctgcgagggcccggcgcggctgctgctgactatgcggcggcgcggggacagctgcgcaaggtgcttttctttgccattcccgagaacctgctcagctccgccgcagacgacctggcggccggcgacgacgacgatggcactgccgcagcagcagccggcggcgccggccagcagcagcctatgagctccctcggcgaggaccacgcagcggcggctcgcacggacgccggcgccggcactgtcactggcaccgctgcggcggcagcagcagcagcaggcggcgaggtaggctcggcggaggacgctgcggcggcagcgcggcagcaggtggtggccacggcggcggcgctgggccggcggggcttcgtgatgacgtgggtgtggctggctcgtgcgcggcagcaggcgctgctgccgcgcctcagtccgctgcagcgcgcgaggcggcaggcggtggctgcctttcatgcgctactgccctcggtggcgggtgctgccagggatggaggcggtgcgggtggtggcggcagcgctcagcggggcggggccgccaaaagccgcggcagcggcggtgagggtgctgacagaggcgcgaagctgccgggtcgcttcacggcgtacgtgtcgctgttcctggagcaggcgtgcccgctgcaggtggagctgcagcagctgcagggggccctgcaggaggcactgcggcggctggagcagcagcagcagcagcagacgctgggtggcagtagcactggcgccgcagcgggtggcggcagtggtgctggcggggaacagcagcgcgacgtggtgcagctgcttgacctggcgtacgagtacacggagcggctggcggcggaggcggcggtgctggacgtggccagccacgcgggccgccacgccgcctgcgacgcggcctggctggctgctggggcgctggagccgctgcggctgctggcggcggaggtgcgccgggagctgggccagcagctgccggggcaggcgccggggcaggagctggagccctag

SEQ ID NO: 135 - DNA, 942 bp, Chlamydomonas reinhardtii
atggtgcaggtctacactgagccgttgtgcaggcggtactatggtagtgtcattggagaggcagcactgttccgcttttttgcgtacctctccgccatcgtgctggctctggtcgttgccttcgccaccgggggcttctgggtgaagctcacgccagataatgtgcaggcgacagtatcatacacacaggatgccatcctcatatttgagggtgcggagactgggcaagttgcgttctggagcacatcacctgtgctgaacgcggagttctccaacctgtatactgcggccagcgttcaggtgtcgtctatggatgtgaacgatgatgggaaggcggacctgatcactttccaggccagcgtggccaatgacttcccagttcacagcgtcaaggcgctgttgcagcttcactactctctgacaggccacctgcagctggacatgtacagcttcgcgtacctggcgcagagctctccggctccaggggccgcactctacacggatggagagctcttgctgtcatccacgaaccagcttcaggaccggaactacaactccagatacaacacgccaatgctgaactccagcacgccatcctactccacagccgtgcagccgtcagtagcgctggagatgcaaagcatcctgagcagctacctgagccgcaacttcaccaccacctacagcaacaactttcccgtctgggtgggcggcacagggacctcgtttaatttgcaaatgcgaatacggattccgcccaaccaggtcatcttctacaggcctcaagccattgagatgctcaagttcggttggatccagtggcttgccacgttcattgtgctgtggtacctgctgcaatgggcagagtggtttgtgttctactaccgtttggtcgagacgcgggttgtttcagacctacaaccaaggcaacagcgtttttaa

SEQ ID NO: 136 - DNA, 1401 bp, Chlamydomonas reinhardtii
atgggcagcggggagaagggtgtgatgctctgtgagcgaccaaagccctccgcggtcgactcgtcgcctgggctgaagccgtttctcccatcgtcggtgccctctaatattgagccgctggggctggtaccaacccaaaaggtgttccctcccagcctggcgcccaagcaggttagcgccaccagcaagcatgtgaagtacgtgcggaacctggagcaggagaaccgtgaggcggcgctgcgggaagaggagcggcggatggctgaggcggccaaggcggagagcgtgacttcgttcaacgcgcaactgcgagccgcaatcctgaccggagaagatgtcagcttctggcggccagctaaaggcgcggaggcggtccggcagtccctagcggagtccgtcgcacggaccgccgccctgggcagcggcagcccgcaatcaacagccgccgcagcggctgcagcggaggcggcgcgcaagcgtctggagctcacggcgaatgttagcgggttcgtggaggaggtggttggcgaagccaaccagaagctgacggcaacgagcaaggtcgccatggcctcgttcgtagatgaccttttctcagaagccgcgggcgcactagcactaggcggcgaggacgaggaggctgcagggcgggcagacggcacagcggaggccagcaccagtgccgccgccgccgcaggcggtgccaagcccggggcggccaaggccgcggccgcgggcgggcgcaaggtgcgggtggcgtcggctgcgggcaagccggcgtgggctctgagctcggagcaggtggagaagctggaggaagctgaggaggaggagctgctaaaattcgcggatgacctggactttgacaacttcatgtcctctctcgacgaccccgagctgcaggagagcgtgcaggcgctgcgtggcgcggacggcaagggaccagcgccgggcgaggagaaggcctggcgccagaacctggtcaaggccatgaaccatgtggccatgcggcaggtggcggcgcggcgggcggcggcggcggcggcgggcggcgccgacagggatgacgcgtgcagcattgcgggcatgtcggagggcggggctagcatggtgtcacgcgccacggctgcgagccggatgaagtcagaggcggcggcggcgaaacgggcggcgctggcggagggtggcgagggcggcggcaattgggagtcgtcgacgcgcgcgggcgaggacgtggcgcggatggagcggtcaaaggcggcggcggcggaggcggcggacttcctgcgggaaaatcccgagctgcgggcggtgcactcaccggcgagtgtgcgcgcgatgatcaccaagactgaggcggcgggcgcgtccgggggcagcccgcttgcgaaggcatcgtga

SEQ ID NO: 137 - DNA, 1298 bp, Chlamydomonas reinhardtii
catcgcgcatcggcccggccgcggcgccagcaaggagccttcacgcagccaacgtaccagtcgctcatgttcgcgctatgggcgaagcagccacgcagccacgcgccccagctggtgcacttctgcgacaggccgctcccccagctctgggcccctgatccccgtgccacgttgctgcgcttaggagcgccgcgactgctcttcgggcaggcgcagcatctcgtgacggacctggtgatctacgagtcgcagcaacagctgccgcagccagggtttcagcgtaacccgcctgcgctgctggtggatgtgcgacgcagcctcaaggagcggatgcagcggcccccagaggacgcaaaggcctgctcgaacggcacattcattgcgttctttgtgacagctggtcacaaaaccgccgccaagcagctggctggtggtggcttggcgcgtgcgctcttctactcggacgagtggcgctgtgtgaacctggagccggagctgctggactggtatgcggacttcttcgacttctgcgggctcccccagtaccccacacgcgactcgctgtttctgcctgacgtgtgcgcccagcttgtcacgctgccgcagccggggccagccccgccagtgcacgtgctcatgccgcgtggctcgcagacgccccggagcgccatcctacccggcgactacttctggctgcaggaccacacctttgtggcctgcgcggcccagacaagcagcattcgctgcacccgcagcggctgcggggcggagtgccagcacgtcaagcaggtggaggaggtcttcgggaagcagctgccgccggcagccctcggctcccgccacaagccgccaaatgaggagcccgggcctgcaagtgaacaggctggcgtgatagcggtagcagcggcaacagcggcagccgaaccgccggcggaggtggcatcgccgccgccgccgtccgtgcggtaccccttcccatgtggcgccggcacagctgatgccatggccgctggggagctgtccccgcgcaagctgatatgcgacgggacggccgtcacctaccagatcgtccactattgcggcgtggcgctcaccaccctggcgccgccgccgggcaccctgcttccagtggccgcctttgtagcgcgcctgagctgcctgtcggagaagtgcaagggctttggcggcgggccgcagcttgcttcgtgcggagcagcatccgccgacacggacgagtgcctgcgcctggtggcctatcctgcgtccaccagctgtacgccacgggcttgtgggggtaa

SEQ ID NO: 138 - DNA, 2217 bp, Chlamydomonas reinhardtii
atggctccgacccaagcgggccacgacacagcctacctcaaagagaccgtaggcgaggccctcgctcggggatgcgcagccgctattagcgcacagccaaacgaccccgtggagtatctgggcctatggctgctcaaatacgtgaaaaatgctgaagtagaagggaacttttatcgcgagcggcaacaggatttgcaaaagaagaaggaccgactggtcaaggaggcgcagtcggagcaggcagccaagtcagtcgcgctcacgcgcaaggaggccgcggacgcgctggcgctggtgaccgccgagccgcgcgagctactggaggccgcggtgaaactggtcaagcagcacacagccgcaggcgcagcatatgccgccgtggtagcagagcctgaggagccggactgggtggcgccagaggacgacgaggcggcggcagtggagacggaggacgaggccgccggcggcgccgcgctcgcagagggcgaggagccgccgccggagcccgagccggagccggaagcggcgccggaggacggcgagggcgatgcgcccgcgcccaagattccgcgccccgtggactacagcaagaagtactttgcctacgtggccgccagtgcggggcaggagcacgtgcttgaggccgacctgtaccgccccgcgccgccgcccgaggacgccgacgaggacttcaagcccgagccgctgccgtacagcttccgcgtgctggacgagaagctgcccatgctgtatgtgcccaacgtggccgccgaggagcgcgtcaagttcttccgcaagttccccaagataggctcctaccaggcctgcggcgttgcgctgccggccagcggcgagttcaaggcgctgctggcggcggacacgctgttcccggagggctcgggccagccgctgagtgccgacgaccgcgactttgtgtgggaggtgtcgcagtcgctcagccgcgcgctggaggcggtgcaggcgcgtgccgccgaggcgctggcggccacctccgcggcggaggcggtggaggagctgaaggccaaggtggcggagctgcgcgagcaggcggcggcagaggccgcggcggcggcgccgccgccgcctgccgagggcgaggagggtgagggcgaggcgccgccggcggaggaggagccaccggcggaagaggaggcggaggaggaggaggaggaggccgaggagggggcggaggagggtgctgaggagggcgaggagggtgaggaggcgccgcccaagcccaagaagaagaagaaggtgttcaaccccattcccgggctgcaggccgccattgagaagctcacggccgcggcggaggccgctaccgaggccgacgcgcgggcgcaggccgccgtggcgctggagaagcaggcgctggatgaggtggtggcgttggcgagctcacactcggacgcgacgctttccagcctgcgcaacatgctgagcgtgccgcagggcacctaccacgtggtgaaggcgctgctgcacctgctgggccgccccgccgcctcgttctcgacctggaagcgcgcgcacagccacttcagcccgcggctgtttgaggacatggccgcctacgacgcaacggcggagcgcgacatggcggtgtggggccgcgtgcgcagctgctacaaggcggcaccggcggccaagaagctggacgcggagatgccgaacacgctgtttggcagcgtggctctgatgtacatcaagcaggtgcggcgggtggcgcgcaaggcagtgctgcagcgggagctggcggccaagctggccaaggcgcagcaggacctggccgacaagcaggcggcgctggttgaggcggagcgcgtcaaggccgagcgggaggcagaggaggcgcgcctggccgcggaggcggaggcggccgccgccgccgaggcggaggccgctgcgcgggcagcggctgaggcggaggcggcagctgccgcggaggcggcggcggaggcagcggctgaggcggctgctgcagcggcagaggcggcggcggaggccggagagggtgaggcggtggcggagcgagaggctgctccggctgaggccgaggctgctccggctgagggggaggcggcgccgccggcggagggtgagggggaagcgcagccggcccaggaggggtcgaacagctcgagcagctctagtgactcgtcgagttcggaggagtccaaggccgctgcggagtaa

SEQ ID NO: 139 - DNA, 396 bp, Chlamydomonas reinhardtii; identical to SEQ ID NO: 25

SEQ ID NO: 140 - DNA, 909 bp, Chlamydomonas reinhardtii
atggtaattacggaggttcggcaggacggcacaccggtggactggagcggctcacgcttggtcgggaacaaggactacactgttattgcagagccagcggcctcgattttccaggtgctccagaacggcaaaacagccaacaccatccggggccggccctgcgtgtacctgctgcgcgcccggctgaaggacgggcccaaggctggggagtgggtcaatgtgtacctcggctgccagcaatccgacacgctgagctactcgcgctgggacgcttacctggtccatggcaagtccctgcggtggtcggtgcgctgccaagcattgcatggccggccggggcccacacaggagccggccaagtgggctgggtgggcctggctgctgacacactgtgatgctgcagagctgcggttcattgacctgtctgggctgactaaggagcaagtcttcagggtggagcgcagcttccttgacaagtacgactttcccttcaactctaccgacaaccgctgctaccgcctcactgtcgcgaccttctggggcagctgcagcattcccaagatgcccatcgagctcaggcgctgggtgggggaggagtggtggtacgcggggctggcaaacctggagcagctgctggtggagcctggcgacctcgccaacagcctcggcaagcctgctcagtcggtggcgtgtgcggctgacggtgcattgaacacccggaacgagttcacgcaccctggcagcgtggctgccatggaccaggaggtctccgagatgatggagctcatcacgccgccggagctggaggacaagtgccctgaggagtgcatgttcctcacggcgtacgaggacatcaagaacgccttcccgcaccgcttcagccaggttggtggcgctcgacagcgttga

SEQ ID NO: 141 - DNA, 2325 bp, Chlamydomonas reinhardtii
atggtgcaaccagtctcggtcctcacgccaggcgtgcagagtggacttggtggactaggtgcttcgcgtcctggggcctcccaggcttggccgcgtcgacctgctgttctgagtacattcctgggcacctccatgctgtggcgtgggcatcgtgcggcttcttcgacgggtggccatgtggcgcagcatgtatgctcggcgtcgtccaagtcggggcgcacagtcaagataacccggcggcgtggttcaggccacagcagcagcggtggcacgggactggtggcggtgcccgccgacgggcccgccacttcgtcgggacgatacagcggcagcatgctgggctcggcctcacggacaacctccgggcggagtactacgtcggcgccgccgcaagtgcgggaagcggagtacctgagctcggacaatggcagcgctagtgacaccaacgcattcgcgtggggctggtgggagtcgctgccatcccgctacaaaatcatcgtgggcacggcagtgtcgtttgtcatctgcaacctggacaaggtcaacctgtccgtctgcatcatccccatggcccgcgactttggctggagccccaccgtggcgggcctggtgcagagcgccttcttcttgggctacatggtgtgccagctgccgggcggctacctgaacagcaggctgggcggccgccgcattctgcccgccggcgtgctactgtacagcgccgcaaccggcgtggtgccgtgggtggcggccagcgtgccggcgctgtgcgtgtcacgcgcctttgtggggttcggccaggccacggcgccctctgctgccaccgacatgattgcgcgcgctgtgccgcccagcgagcgcgcccgagccgtcactttcgtcttctctgggttccacgtgggctccatcctgggcctgctgacggcgccctggctgatccagcattacggctggcaatccgtgttcgtgacctttggcgcgctaggcttcgtgtggtggctgtggttcgagcagggcatcatgtcgcgcatcaaggctgaggagcccgacttcgccacccgcctggtgtccgactcgcgccgcatcgcgcccatgaccgacgccaacagcgtcacgtccgcctcctcctccgtagtcgtgaccaacaaggcggtggccaaccggggcgcaggcgcggcagccgccgcggcggcggcagctgctgccgcggcggagccgccgccgatgccgtggcgcgctttcctgcggagcaccccggtctgggcgctggcctacacacacttcgccaacaactggttccactacaccatgctcgcctggctgcccacctactttgtggacacgctgtctgtggacctgctgcatgcgtcccagaccgcgctattgccgcctctggccggtattgccgcctccgccgcggccggcgccgcggccgacgcgctcatcagccgcggcgtgcgcgtgccggtggtgcgcaagctggtgcagggcgtcgcctttctggtgcccacggcgctgctgctggcggcctgcacgccggccatcgcggatgacagcggcctgacggtggctgccatcacggtggcgctgggactgagcagcttcagcctggcgggactgttctgcacacaccaggacatgtcgcccaagtacgcgcccatcctgctgggcctgaccaacaccaccgccgccgtccccggcttgctgggcgtggcgtccgtgggctacctgtttgagcagacgcagtcctgggaggcggcgctgttcctgccctccgccttcttcatggtcacggccgccgcagtctacacgctgtgggggcgtaacgaccccatcgacttcgacgccgccgacaacggccccttcaggtttgagtcgcggatcgctgcgatcaagaaggccgttgacgacgcctttgactttggccagaagccctcggccggcactgatgtggagcgggaggtggacgtgcctgaggtgccgccccggccgccctccagcctgctgggccccctggccgacctggtccgcggcaccagcagcgccaccgccagcggcgacgacggcgacgagggcggcagcgtgcgccgccgcgtcggcggcgccgcccggaacgccgctggcagcgggcgccggaccagcggctccagcagctcgggcagcggccggcgcaccactgtcgggagccagagccggcggtcgaccggtgggagccagagcaaggcgactggcggcggccgccgggtgcaggaggcggaggaggaggggccgggcggcgtgtgggagcgactgcgcgcgctgctgggccagccccgcgagtactaa

SEQ ID NO: 142 - DNA, 360 bp, Chlamydomonas reinhardtii
atggagaagctacgcgccgcgggcaaggccgtggagaccgtgttcgtgagcggcgaccgcgacgaggcctcgatgaacgagtaccacagccacatgacgtggccggcgctgccgttctcggacaagaagcgcaacgacgagctcaactcgtgcttcgaggtggagggcatccccacgctggtggtgctggacgagcagttcaacgtaatcacaaccgacggccgtgaggccgtggcgtccgacaccgagtgcacgcgcttctcctggcgcccgcagcctactcatcagctgcgtggcggcaccatcgacaacatcaacgaaggtccctgtcatggtggtggtggtaggtgcggcggatga

SEQ ID NO: 143 - DNA, 1413 bp, Chlamydomonas reinhardtii
atggcgcctgccgtggtctgcgatggggacgtgtgccgcaaggtggacgctgaggaggccgcagctgccgcctcccccgctcctgctgcggccgaggagcccaaggtcttccagattctgggcgactcactgctcggccccaacggcactcaggtgcctgtctccagcatcactggtcctggcaaggtggttgcgctgtacttctccgcgcactggtgcccgccctgccgccacttcacgccccaactggcctccatctacgccaacttcaagaaggatcacgcacgcaaggctgactgggaggtggtgtttgtgagcagcgaccgcgatgaggagtcatttaaggagtactttggcgagatgccgtggaccgccctgccctacggcaagcgtgaggccaaagcacagctgtctaagctatacaaggtgcgcggcatccctaccctggtcatcctggatggcgagaccggtgaggtgatcaccacgagcgggcgagacgccgtcagcagcgacgagaagtgcgagggcttcccctggcggccgcgcacattcgagcagatcatggagggcgcggtgctggtggagcccaagacaggcgctgaggtgccggcgctggagcggctgcgcggcaaggtgtcactgctgtacttttccgcgtcctggtgcccgccctgccgccgctttacgccgcagctagtgacggctatggagaagctatgcgccgcgggcaaggccgtggaggccgtgttcgtgagcggcgaccgcgacgaggcctcgatgaacgagtaccacagccacatgacgtggccggcgctgccgttctcggacaagaagcgcaacgacgagctcaactcgcgcttcgaggtggagggcatccccacgctggtggtgctggacgagcagttcaacgtaatcaccaccgacggccgtgaggccgtggcgtccgacatcgagtgcacacgcttcccctggcgcccccagcctttcgagcagctgaccggcagcaccgcgaatcgtatcaacgatgggcccgtgctggtgctggtggtagatacggcggaccagaaggccgcggaggaggtggctaccagcgcgctggccgaggttgcggctgccaccaaggccgcgcccggtggtgacgactggggtttcctgtgggcccaccgcggcgaggagattgccaagcgtgtgctcgcgtttgcggggttggtgaaggactctgaggtggagctgccggcggggcacgcggcggtgatcattgacgtgcccaaccacgaggcagtatgggacctggcgggcaagggtgtggaggttagtgccgtggggctgagcggcgctgtgtcggacttcaaggcgggcaagctgggacccggcaagaagctcggtggtgagggcgatgacgacgatgagtga

SEQ ID NO: 144 - DNA, 2295 bp, Chlamydomonas reinhardtii
atgggttgctcgtcttcaaaggatgaggtggagctcgcccagcaggtgctgggtgcgaagaaggccgctgacaccaaagcggtgcggcgactgtcggcgctggggctggaagacggggaggtgtggatcacgcgccagaccacggatatacgcaaggtgttcaagtttgggcagcaaatcaacaaagggcagttcggcgtgatccacgtggtcacagacgcggcgggcaacaagtacgcgtgcaagcagatcagcaaacgcaagctgacagggcccaactccattcgcgacatacggagggagattgagatcatgcaccaccttcgcgggcaccccagcgtcatcaccttccacggcgtgtacgaggacgtgtcagacgtgtacatggtcatggagctgtgcacgggcggtgacctgtttgagaagatcgagaagatgtccactgtcacggagcgggcggcggccgcgctgttccgggagctggtggagtgcgtggcgtactgccacacactgggcgtcatgcaccgagacctcaagccggagaacttcctggtcacggaccgcaccggcgacgcgcgcatcaagctgtctgactttgggctgtccaccttcttccgcgaggggcaggccgactttgctgacgtgctggggagcgcctattacatggcgccggaggtgctggagcgcagctacggcaagagctgcgacgtgtggtcgctgggcgtcatcctgcacgtgctgctgtcgggggcgccgcccttcgccggggccacggacgcggaaattatcaaggcggtgcggagcagggatgtggacctgtccgccaagccctggcccgccatcagccgccacgcccgccacctggtgtcgcgcatgctggagaaggaccccgagcagcgcatccaactggaccaggtgttgacacacccctggctccggttggacggcaccgcgcctgtgcgggcggttcccacgggtgtgcgcgaccgcgtccgccagttccgcacgctcaacctgctcaagcgcgaggcgcgccgcgtcatggccgcctcgctgccgcccgaggaggtggcgggcctcaagaacctgtttgaggagctggacgccaacgccgacgggctggtgtcgctggaggacctggtggcggggctggcgcgcaggggcgaggcactggccggcgaggaggcggcggcgctgctgcgaagtatggacctgaacggcgacggattcattgactaccgcgaattcgtggccgccacctacacgctgagcaagctgcagcagagcgacgtgctgctcaagaccttccgccacttcgacctggacggagacggctacatcagcaaggaggagctggccgccgcgctggcccagctgcccgccgccgccagctcggccgcctcagcgcgagagagcgtcacggggctgctggcggaggcggacttggacaaggacggccggctgaactaccgcgagttctgcaccatgctgctggccgcgccggggctggaggcgggaggcagcgaggcagacgccaacgcggccgaggtgcaggcggccctgcggctgtccggaattgacctggactcggcggggctgccgggagccttgaatggcaacgcagcggcggcgctgccggcctcggcggcggcggcggtggcggctgcagtggcggcgggcttccggcccgggagccacagcaccaatgacacggcgtgggacccgagcttcggcagcggcaagcgcacgagcacggggggcggggtgcgcacaagcacgggcggcggcattcgcacgagtccgagcggggtgcaggcgagcatcggcagccggccgcaggcgccgtcgccgcagcggtctgggtcgctggcggcggcaccgccgtccagctcacaggcgtcgtcgcggtcgcagcagccatcgccgatggtttcgacatcgcaaatgggcatgctgcagcagcagcagcagcagcagcagcagcagcagcagcagcagcagcagcagcagcagcagcagcactcgcgttcgcagcagcactcgcccatggtgggtggccacaggctgtcgtcggcgcagtcacagtcgcagtcgcagcagctgcggcagctgcagcaacagcagtcccgcaagcagcaggcgcaacagcaacagccacaacagccgggcgtgtgggcagacgacttcagcgacgctgggccgctggactcggaagatgaagacatcatgaaggcgtcacggcggcagccgcagcaagtgcagacgcagtcgagtcagcagtcgcatcgggcgtag

SEQ ID NO: 145 - DNA, 1167 bp, Chlamydomonas reinhardtii
atgtcggagacggagaagcggaggggtggcattatcccgttccgcattccccttcccaacccgctggcctggcggccgcccttcattccgggactgggccgccgccgcaaggaccgcaccaagcactttgcgtccaccagcgtggtcagcgtggccaccatcagcgacagcgtgctgcaggcggcgggcagcggcgcgtctgcggccgccgcaccgccgccggtcaaggtggcgctgaagcccgccagcgacgtgttcgccggcgccctggctcgcgctgcctcccagtccaccatccacccgctggacacgctcaaggtgcggctgcagaccagcagggctcgtgccgcctcggctatgccgccgccgcccggactgtccaagattgggcagctggtgccgccgccggctgcacccggcggcggcgcggttggggcgctggcccgcttcgacggtcgtgcggtgctggcgaccctgggcagcctgtacaggggcgtggtgggtgctgccagtggcgctggcatcgccattggcgcctacttcgctgtgtacggcgtggcgtgcaacaccctgtcgcgctacaccgacctaccgcccacgagtgtcgcgtttgtgggcggcggcattgcggcgctgggcagctcattcgtcaaggtgccgctggcggtgtgcatccgcagcgtgcaggcgggcgtgtaccccaacgtgtttgcggccgcccgctccatcacgtcggcggccggcccccgcggcctgtttaccggctacctgcccacggtgctggaggacgtgcccgacatggccatcaagttcgccgcgtacgagagcatgcgacaggtgcaccgcgccatgaacggcggtcggaacgccagcgtgcaggaggacttcgccatgggcgccattgcaggcgcactggctgctgctgcgaccacccccctggacgtgatcaagaccaacatgatgtgcaacgccgcgggccggccctccatggcctcggctgcgtccctggtgctgcagcagggcggtccaaaggcgttcttccggggcgtgggcgcccgcgcgctgagcaacggcgtcaacagcgccgtgttctttgtgttctttgaggccatccgcggggccatcgccaaccgcgtcaagagccacccagtgcagattgagagttga

SEQ ID NO: 146 - DNA, 1182 bp, Chlamydomonas reinhardtii
atgtgtctttctttcttcgtgttggacgcggctgaagggcctcgtttcctgctcgccttcaaccgcgacgagtatttcgacagctccgaccctgtcgccccgcacacacacgccaacccctacacacacgccagccgcggcggcattaccaccgccttcctaacgggggacgcgtcgcccgcgaattttgcgcagtctctggacgccgcaaacttccacggttttaacctggtccttgcggaactggccgggcccgcgcccagcctggtgtacacacacaacggcgcgctggtcaccagcagcacagccgagccggccgggaactgtaaccgcagcggcggcggtggtggctgcgacgttaatggcagcaatggcccggttggggcccgcgaggatggcaaggatggcaaggagcagggcggccttgcggcggggaagcggcggctgctcggggcgtctacgttgggcgtcagcaacgggctgctgctggagtggcccaaggtggccagcggcgtggcggtgctgagtcagctgctgcccgagatacggcagggccagccggtgccctggtcccgcctgttcattgagctgctgggggacgacacccgactggtgccgcccagctgcggccggcagcaggagggggcggcggaggaggcgggggcgcagcaccagggagccagcacaggtggcatcagcggcggcggcgtggccgcagcccaggccgtggccccggctgacgaggtcgccgcgcacgtcggcagcggcgccgcagtgcacgtggacggccgacccatcgcaccagcaccggccggcgctggcgccggcgccggtgccggccacaaccgcggccacggccatggccacggcagcaatagcagcagcagcagcagcggctgtagcaatggagctggcgggaatggcggcggctgtagcagcgctgctggcggcggcggcgggggcggcggcggcgcgggtgacagctactttgagagggagctggagcacatcacgagcggccgctttgtggcggaggtggactcaccgtttggcaagtacggcactcggtcgcagacggcgttggtggtgtggctggacgggcgtgtggagatgcgggagcgggcgcgggagcccgacggcagctggcgcgagagcgcgctggacttcgccatttcgctgtag

SEQ ID NO: 147 - DNA, 366 bp, Chlamydomonas reinhardtii
atgtcttacttcgcacgatttacgcaggcctcgtcgatgcggcatgcggcagctgcctggcgcgcaggcgcgacgcagatgcatgcggcgcgtgtggcgatggccgcctcacagcggctggcgggcgggcccgtgttctccgcgccgccgccgccgccgcccagccccgcggccggcttctccagcagccccgccatgggcacctccttcgcggcctcgggccttctgggcagctccggcggcgcctccacggccttggagggcagcgacggcactggagagggtaacagcctaggcggcgcctcccataaagaggccgttctagcggttacaaagcgatgtaggaaacgacgcaaacgcttttag

SEQ ID NO: 148 - DNA, 2112 bp, Chlamydomonas reinhardtii
atgggccctggttggcccaaggagctcgaggacgcggccattgtgcaggccttcacccgctgccaccactccgaccccgaggccttctccatccccctgtacgccgcgggcgacgacaactccaagattgtggcacaggccttcggccgcgcccatacccatggcgccgtcgtgctcctgggctacagctggcgcgacggcccgcagcccggctggggcgatctgctcgcaaagctggtcaccgacttcgctgacggcgcctacacagcccacgccgccggccgcttcacgactgtggctgccgccaccgcctcctcccacgacgcggcggacgcggctgacatgggcagcgacggcaccgacaacaactcgccgtacgacttggactcgtcctacagccaggatctggatctggattcggtgctggagggcgctggcggcctgtccgacgaggcggcggaggtggtgcgccgcttcttgaccgccaccatgggataccctggctacccgggttacccgggttacccgggttacccgggctacccgggttaccctggcgtgccggcctaccccccgcccatctacatctcgccaccgcctgccgtgctggactcgcccccgcccgccactgcgccatcgccttcgcccgcggagtcttccccgtctccttcaccctctccttccccttcgccctcgcccgtctacccctctccttccccttcgccctcgcccgtctacccctctccttccccttcgccctcgcccgtctacccctctccttctccttcgccctcgcccgtctaccccactccttctccttcgccctcgcccgtctacccctctccttctccttcgccctcgcccgtctacccctctccttctccctcgccctcgcccgtcgacccctctccttccccttcgccctcacccatcgacccctctccttccccctcgccctcgcccgtcgaccccgctccttccccctcgccctcacccgtcgacccctctccttccccttcgcccgtcgacccctcgccctctccttccccctcgccctctccctcgcccgtcgacccctcgccttccccctcgccccccgtgtacgccccgccgccctcgcccgcaccccctgcgcccgcccgtgttctgttcatggattttgccaacctccccgccactggtgtgcaggcacccaccaggccggtggtgtggtacgacgatcccgacttcgacagcctgctggccgccagccccaacaacagcaagctgtggatggtgaagccggaccgggagccgtgtgttggctgcggccagtgcccccgggcctggtaccccaccaacaccagcgacaccaccaacggcttcaactacaccaccattgtggtttacttccgtgagccaatgctcatcaagagcgtgcgcctgaacgaggtctaccagccgggcggcgtgcagcagatcttcctgctgcagtggcccgccgtgcccgtgccgctcgtcttccccaacgccaccgcactcggccccgagtccgtcaagaagcaagacattgtgttcaacggccccgacacgaccaagacctgcccgggcgtgctgaatgtcgacgtgggcgtccagcgctccgcaatgaaggcacctgtgcgcaagggcttcacgcagaagcgcctgcagcgcggcctcaagaagcgtgccgtgggcggtgtgggaatcaccgtggcgctgccgctcccgagcgggccaggcggcagcaatggcaacggtaacggcaatggcaacggtcacgacaatggcaacaacggcaacggctggggcgcgcgccggcagctgcgcgccgctggcggcaacggcaacggcaacagtggtggtaatggcaacggcaacggcggcggtaatggcaacggtggcggtaacggcaacggcaacggcggtggtaatggcaacggtggcggtaatggcaacggcaacggcggcgatgactgggagcagctgctgacgactttcatcggtgacattcgcttcgatgggcgcgttctgtatcctcaggacccctcgatcttcgtgccttacgcgccgcccaagccgtacaacaagaagctcaagaacacggcgtaa

SEQ ID NO: 149 - DNA, 2577 bp, Chlamydomonas reinhardtii
atgtatgagcttggtcttgatatcgatggcaagccggcccatccggctgcaaccattgtgagcggcgacgactcgtcgctcgatggcatcgctctgagccgcgcgacgacaggtggtctgcttattgtggttggaagccctgccaaccttcataaaaccattggggcggcctttgatgtcggctcggatggtcgccgctgcgactctacgtccaacggtggctcggtcacccacggcagcaggccgaggctgcacgctgccgccgctacgctcttcggctccgaggacgctctggatgcggagtggccccagacactcgaggcggtcgcggtcacgcactccattgccgcatgcaacgtcggcggcgccgtgacgcaggtcccgctttacttctcgcccagcgatggaagcatcgtggcggtggccttcacctccgcctccccccgcaagcgcaccgtggtgtggctcggctacgactgggcggctgggcctcagacggcctggggtgccgtgctggccaaactcatcgacacgcacgccctgctgaccgccacctcctcggcggccgctgcctccctgtcctccgcatcctccgccactgccggagagcccaaggtcgtgcacatcaccaccacttcctcgtccgccgccgcctccaacaccggctgcggtagcggaacctgttcccacagccacctagtcatggccaccctggccgctgccgcttcgtcttccgccgcatccgcctctgccgcttcgtcttcagcctctacccttgcgcacaccggcggctccgagaccgagttcgcggctgatgcagccaaggatggtgatgacgctgccgcggagcccgtgttggtggatgacgcagccatggatgccgccctggactccatgccggatgctgtcagcgatctgtcagacggcgtcagcgaagtggtccgccgcatgatggcggccacaaccggcgccggcacgtacccggccccgccctccccggagcccgcctccccggcgcccccctccccggcgcccctgacgcccgcgccgccctcccctcggccgcccaagccccggaagtccccgccctcgccccccaccacgccgccccccctggcgcccccctcgcctccctcgccgcccgccccgccctcgccgccgcccccgctgccccccgggcttgctgccgaggtccagggttacaactccgacacgagcgccccgccgggcttcaacatcagcgacacactgtcggtgcagaacttcagccgcgacttctgtgagaatgtcaccagggccctggacccgcgcccggatgagtgtgtggtgttcgacatcaagagccacggcggcgccacgcatcaccaccgcctgctgagcgaggcgggcgcgctgcgtgtgtggggccccgaggacctggcagcggagcacccggccctggccgccgccggcatgagccgcctggtgcacctgcgcacctacagcgtgggcgaggcggagctggcggcggtgcgcgcctgggacctgtccgtgtcgctccccgtcaccgccctgccctcctcggtgggcggccgccgcagcctgcagcaaagcacccagaccatcaccctcgccttcgtggtcatctacctagtggaggtgcccctgccgccctcgccgccgccgcgggcgcccaacccgcccggcgtcatggagccgccctcgccgccgccctcgccgcccgccgcgccgccgcacccgccgcgctcgcctccgcggcctcccgtcaacctcaccgctcttgcctcagccgtgggcgccagcgcagtgtaccaggtcttcccgccgccgccctcgccgccctcaccgccctcgcccatgccacccagcccgccgccctcaccgcacccgccgccgctgccgctggcggaccgcatcacgtccgtccgtttctcccgcatggaggccgcgggcgcgcttggcagcaacaagcgtgtggtgtggtggaccgacggtgactttgagtcccagcgcaaggccgtgtggaacagcccgctcaacctggtgtggcgcggcaaggccgcctgcggcaagtgcggcgcctgcggccgcgcctggaagccgcgcggcgacaagttctcggtgcagctgtttttccgcgagccggtgcagcttgatgagatccgcatccgccaagtgtggcatgccggcgtcacggaggtgcggctgttggcttggccggccgtggacgccgtgaaccgcgtctccgacgtcttcctgggcgagccggtgctgcgccagaccgccgacaacaccacctgcaacacctggctcacggtagccatcccgcaggagcgcgccggcaccaaccagaccgtgcggcccatcggctcacaggacgccattccgccgaaactgcgcagcagcactgtgggcggcgtggtgatcaccacacgcacggcggccacggttcgtgccggcacctggatcgacgccgtggatttcagcgggcgtgtgctctatcccaacgacccggctgcgtatgccgcgtatgcgccgggcacgggtggcggtgcgaccattgggcgccggcggtag

SEQ ID NO: 150 - DNA, 1113 bp, Chlamydomonas reinhardtii
atggcgagcctggagcgcgtggcgagccaccgggctgcctcttgctcacaaatcattagcccagttcgttttggacgctggcagagcgtagtgcacgtctcgcggttggaccggcgtgtggccctgccctctcgcgtgctagtctccgcagcagctgctgatgtaccccagcaaggagcacccattacttcttctaccccttatgttcctactgcacatcaatcgattgacgaggacaacgtgttgacttcgttcattgccgagacgctcttgcccactcgccacgggaaatttcggctccgtggctacaagcattcgacggatggcggggcgaccttcaccgagcctaccgcgattgtgtccggcaaggttgaggggcaggaagacgtggcggtgcgcgtgcatgacgcctgcttcacgtcagaggtgctgggctcgctcaagtgcgactgcgcggagcaactggagctggcgctgcgcatgatccagggcgcgccgcccggcattgtgatttacctgcagcaggagggccgcggcatcggcctggccaacaagatcgccgcttactccttgcaggagcaaggcctggatacggtggacgccaaccgggcgctggggctgccggacgactgccgcgagtacacctcggtgcgcaacatgcttcaggacatgggcgtcaagagcatccggctcatcaccaacaacccgcgcaagatcaacacgctcaccaagctgggcatccaggtcaacggccgcatcccctgcctggtggcggcgggtgcgtacaaccagggctacctcgaggccaagcgcgaccgcatggctcacatgctgcccgaggaggaggcgctgggcagctcgctgggcggacccgagccggcggcggcggcggcgcagcgccccaacggcgcgggtgtggaggcgggtgagctcaacggcgacttctgcttctgggaccacagcggcgagcccacgcaggctgtcgctacggtgtacgccaagggtggtatggacctgccgcaggggctagcacatggcgacaacgggcgtgtggtgccggtggcggcagcgcccgcgggcagcagcagcggcagcgatgcgggctcgtcgtga

SEQ ID NO: 151 - DNA, 531 bp, Chlamydomonas reinhardtii
atggcggagctgcacgtcatcgggcaaatccagggtgctatcggcttccccagccagaacctgttctgcaagtggggagtcgctgcagggcgaagctgggagctactagagggtttggactctgggcagacgcaactcgacctggcaccagagggggagccggtcgtgtgggcccatccacttgacctccactacgcatgtcgcggcctagccggctggccaaagctatacttccaagtctggagccaggacgtacatggccgaaatgacatatgcgggtacggcttttgccacgtgccgacggcgccggggcaatacgagattgaatgccccacgtggataccggagggcactgcgggcgagcgcattgcggcgttcttcctgggcggcaatccccggctcaagtacgaggaggtggtgtacacgcccggagatcgcttccgcctcaacaccgtgtcggcggggttggtgcaggtgcagctgggcgtcattgtcaaggactttgagcgcaaccacgtgcactttgggtga

SEQ ID NO: 152 - DNA, 2712 bp, Chlamydomonas reinhardtii
atgcttcacatcctagagaagacagaggaggggcgtaacgctctgcaggagatgctggggccgcttcagcacctgcaatacctgcagcgcacagttcggcagcacgagttggatctcgactcgctcagccgaaatgtagacgagcggccctgggacccctacacagcctttgggctgcgctaccacccgccccacagcggcagcggcagcagcagcagcagctcgccgcaacgggcgcccagcaagcacgccagcaacaaacaccaccacaagtcggggtcgggttctacacacggcagcttcgccgcagctgccgcggcagccaatgcggcggcggaggcggcgaaggtggcggcggacgtggcggcggagatggcggcacgcggtcgcgccctgcacaaggcagaggcggcggacgtggcttcagggggtgacggcagtagcaagagtgatgcaagcggcagtagcagcaataacagagagggtcagaagagcggcggaaaggacagcagtaaaagcagcagtagcagcagcagcagcagcagcagcagtggtagtggcgggacgagccacagctacccgcgcttgaggcttagagaaaaggtggtgcgaggcagcaagcacccggaggagctgcagactgagctgacacggcgcaaggaggcggtggcggcggaggcggaggcgctacagcccagagtgggggccatgctggagcggctcaggggcttgctgcaggccgcggccaacagcagcggcctcgtgccaggcaacgcaactgcagaaacgcaactagcagcaggcgccggcaccgccgccggcgaccccaacgacattgttgcggatcccaacgacctggatctgtacgagctgctactgccgcgctgcgtcctggcgcgcctggatccaatcaactatgtgtcgtacccggcgcggcccttcgtgtccatcgtactgtcgtactcgggccggcggctgccgcacgttctgtacgaggttgcggagccgttgttggcgtgcgccgccggaagggacctgccgccgtggcctggtccggaggacggcagtggcggcggcggcggtgtcggcggcggcggtgctgccgccgccggggatggtagtagtggtggcggcggcggcgcggctggtggcaaagggccgttgaacgagccagtgtttttgccactgcctttagagatcctagtggcatttgacgaggtcagtgaggcggcgggctgggcggcggcggcggcggacagcggtggccgcatcatcccggtcttccggcccggcgtggcagacgtcagcgtcagtggcagtagcaacggcactagcggcagtagcaagactggcagcagcagcaacaggggcacaggccggagtgctgggagtccgccgccgctggtgcactgggccaatcgggtggcgcaactggctcagggcgagatactggtggtggtgcaggacggcgactcgctcctctcgccgcttggtcccgagggtgctagcggtggcaccggcagtagcaccagcgcgcgtgtgtgctcctggctgcacgtggcgctgcggacttttgaggcctggccgcagctgggcgcgctgggctcgggcgcctacgtcatggactggcaccccgccgccatcaaccggggacagcacttctgggataaggagcggcggctgccgctgcaatttgtggccgcggcactggccacgccgcaggcggcggagccgcgaggcggcgccgagctgccggcggcaccggtggccgtaaggcgggcggcgtggaggcagctcgggggcttggacgcggggctgggggctgccgctgcgtgtggcgcgtgtgcatggctggacctgtccacacgcctgtggctgggtggctggcaggtggcgcagctgcccctagacctgggcagttcctcgcctgctgccaattcgctgctgctgcccctggacgcccagaggcgcaacctgctcactgcggccgcccccgcgcccgacgcatccgggccagcgcaccggggcacagcagcagtggctgcggagggcgtcggcgacgccgaggcccgggctgggtccaggggccacggcgccggtggtgctggtgcaccggaggccgcggcgtggccccgcagcttggcggcaacaggcgtggcgccagcgggctgggtagcagaggatgtggcgtggtgtgagcggccggagctggcggcgcaccggggccggctggagggcgtgtgcgcgcggctgctgcagctgcggtacggcgcctcgccgtactggcacgacggggcggtcggcccgggcaatgaggatgcaacggctcagggtgagcagcgggctgctgctgctgctgctggggctgcgggcagcattggcggcagtagctttgaagcgggtgagctagggacagggaaagggacagcggctgggataccgactgccgctcgcgcggttgtcggggccgaggaggctggagcggaggacggtgcggagcccggcccgcagggtcggcggagcttgggctcaaggagggcgggctggccggcggcctggttcctgggcagtgacgtgcacgtgcttgtcacggagcaggtgaggcagctgaacctgctgtcgcccctgttccccctgcttgggtggccgggcttgggctccgcctgccctttcggtgcggctggatgccatgagccgcacgcaactgtttaa

SEQ ID NO: 153 - DNA, 2493 bp, Chlamydomonas reinhardtii
atgggcaagcgacggcgtgaggacgctgaggctgaagagcctgcagctgaagccgcggagccgcagcctgaggatgtggccgccgatactggcggcgcggcgcaggacgccggcgcctacgagggcggcgaggagggtgagggaggccgttatggacgccgcaatcggtcgcaagttaatcccgagacattgacgtacctggaggaggtcgtcggccatttccaaaccctggtcgacgatgaggagcgatcgctgctcgtcggcaacgtgcttgacgagctggcaggcaaggaggtcaaggtcggcagcgacccagtgtgcagccgtcacgtggagacgcttatggcttcggcacaagcggggcagctgctgcgcttcctgacctccgtgtcggacgtcgacggcctgttcacgcttgtaagcaaccccttcggctcccacgtggtcgagaagctgctggtgcgagtggagagccagctggacggcatgagcagtgaggagtacgacgagtttgtgcgggtgatgacgctgctggtcgacgcaatctgcccgcatctgtacgactacgccaccgaccgcttcgccacgcacgttgtgcgccgcctgctgtgcctggcggcggggcgcaacgtcctgccgcccgccggcaagcccaagggcaagcagcagcaggaccagtcgctgccggggctggagaacaagcggcgcaaaggcgaggtgctgggcgggctcgctgccaagctgggacccggcaccggcggctcgggcggcggcggcggccacggtgggcatggcagcaaggcggcggcgatggcggcggagctgctgggggcgggtgcggacgaggctccaccggcgcggttgccggagctggtgtccaagctggttggcgcggcctgcagcgacgacctggtgggggcggccatgggcgagatggtgtaccacccctacgcctgcccgctgctgcaggcgctgctgcgcgcggccgcaagcgaccgcaagctgctccgcgggctggtgcctgtgctgctgggcgcaaccgccttcaacgacagcgccaagggcggcgcgggggcggtgctggagggctgccgggacgaggaggtggcggcgctgtttgtggaccccaccgcctcacacctggtggaggcgctgctgcaggttctgcccaagtccatggcggaggagttcatcaagcgcttcatgacgccgcgtcttgccgacctggcgcaccacccctcggctaatttcacgctgcaggccgcgctggcggcggcgcccagcaaggacatggccaaggcgttgtatgagggcctgtccggcctgctgcccgacctgctgcgcaagcgccgcagcggcgtggtggcggcgctggcggcctgcctgggccggcacggcgtgtgccagcgggagctgtgcacggcgctgggctcggcgctggcggggctgccgcaatgggcacacctcaagggcgacgccgcgctggctcccgccttgctctgcctggactcggtggcggtggtgggcgccaacgagcccttcgccggcgcgctggcggccggcagcggcggcgacaaccgcgcgccgcggctttcggcagtgggctgcagcatcctgatccaggtgctgcgctacggccagggcgcatgccgcgccttcacagacagcgtggcggggctgcagccgtacgacgccgcccgggtgggcgccgaccccagcggcagccgcgtgctggaggcgctgctggagggcaacgcgcctgccaaggttaaggcgggcctgctggcgcggctggcgggccactgggagctggtggccagcaccggctcgggcagcttcctggtggaggcagcctaccgctccgcggatgtggatgtcaaggaggccattgcgggccggctggcgtctgccgccaagcaactcgagggcacacactgggggccgcagctgatgagcaaggtgggcgcgagtgcttacgcacgcgaccccgagcagtggcggcggcacgctgcctcggcttccaagaccctggacgcctttgcaaagatgttcggtgacgggcctgcgggtggcgccggcaagggcgcgaagggcaaggccgagcagcaccaacacaagggcagctcgcaaaagggcgaggaggaggcagaggaggcggctgcggcgggcccgtcagggagagacgccgagcttgaagcggggcttgggaagaagaagaaggacaagaaggataaaaagaagcggaaaggggaggagggggacgggcctgacgggcaagccggccgaagcgggcaaggggatgccggcgccgaggaggagacggcggaggtggaggagcaggatgcgacggccaatcaagggaagaagaaaaagcggaaggcaagggaggtggaggctgccgaagaggcgggcggtgcggcggatggcgggacacaagctgcggcctcagaggtcaagagggcaaaaaagcaaaagaagaaggacaagcagtag

SEQ ID NO: 154 - DNA, 402 bp, Chlamydomonas reinhardtii; identical to SEQ ID NO: 40

SEQ ID NO: 155 - DNA, 705 bp, Chlamydomonas reinhardtii
atgcagtgtgcaaggaagtcgatctcgacgagcactactcgcaaggctttcggcgccagccgtggctcggccgtcgtagtaaaggcggtccacagggaggcccccgcggccgccgacgtgccccgccgctcgctgctgctctcctcgctggcggccgcgggcgccgccgccgccacctcgctgctggctgcgccgctgcccgccgccgccgccgacccggtcacggacttcctccgcggctacacgcggccggaggtggggctgcaggaggcggtggtgatcctgatggacgcgcgcagcacactcaaggagatcgaggccctggctgccactcccgaggacagcgaggagcgcttccgcgcgcgcgccctgtggccgtccttcgccaagcgcctgcgcgccgtggcggaggcggcgccggtggcggtggcggcggtcacgggcgcggcggacaaggaggagacgctgggggagatgtacggcggcaaggcgggcggcgcgggggccgctgacgccgtgtacgcggctctgggccgggtgctcaccatcagcggccgcaccatccggcccgaggcgcaggccggacccgaggcggcggcggacgcggaggcagccatcagcggcttcctgggcaagctgccggcaccgctgctggacgaggcgcaggccttccgcgtggagcgggccaaggcggcggctgcgtga

SEQ ID NO: 156 - DNA, 420 bp, Chlamydomonas reinhardtii
atggccccctcagggaaaacatacggtgtcgctgacctgaagcagcacacgacagaaaagtcgtgctggctagttgtacacgggaaggtttacgatgtgaccgagttcctggaggagcacccaggcgggtatgacatcatcctcacctcgacgggcaaggatgccacccaagattttgaggagattgggcacagcaactctgcaaagaagcttctggagaagtacgtgatcggagagtttgagggtggcgacagcgctcccgccgtggccaaggtgcctccgcagagcgccaacgcggcgaagcagcagcccgctaagagtgcggcgacgcgaacattccacgtcatcctcccactgctcatactggcgctggcgctggcgctcaacttctacatgatgagccagaagaagtctgcatga

SEQ ID NO: 157 - DNA, 1260 bp, Chlamydomonas reinhardtii
atgaaggtcatcagctataacatattagctccgaagtatgcagggtacaacaactactgcccgccgcagctgctggcgtgggcataccggcgggagctggtgctgcaggagctgagccactacggggcggacttggtggcgctgcaggagtgtgacgaggccttctacggcgcagagctgggcggctggatggcggcggcgggcatgcagggcagcttcctgccgcggccggtgggcccggtgccgggtcccacggagggcattgcggtgctgtggcgctccgcggcgctggagctggtggcgccgccgcgcagcctgctgtactcggagctggggccggaggcggcggggctgccggcagaggtggcaggcacgcagccgtggctgaagctgcgggagctgggcgagggcgcggtgatggcgctgctgcggcaccggggctcgggccgcctgctgctgttctgctgcacacacctgttctggaaccccgtgttcccagatgtcaaggcactgcaggccgcgttgctgtgtgccgagctggccgcgtacagccggcaggcggcggcccagcagcagcaggaggaggtggggccggtgccggtggtgctgtgcggcgacttcaacagcctggcagagaagcggctgccggacggcttcgaccctcaggtgccggagggcgggcggttggtcagtggcgtgtacgaactcttgtcgggcggcgccctggcccccgagcaccccgaccacccgcacagccgcgtgtggcagccggggacgatggcgcgcaccgtcacgcccgccggcggcgagggagcgccgcgcttcccggcgctgccgctcagctcgtccgggttgcggctaggcagcctgaacgcgctggcattcgggcgggagccgcccgtgaccaaccgcaccgcccacttcgcgggctgtctggactacgtgtggctcagccagccccacctgcaggtggcggcggcgctggccctgccgtacgaggacggcggcagcccgccgctcacggggcccgccgccgccgacgcacctgcgggcgctgctggggcgcaggggcccggggaaaggggggaaactggggttacggggccaggggcgggggcgagggtgggggtgggggtgggcgctgcgcggccgggcacgtggcgggacccgctggctgacgtggccatggtggcggtgccggaccagcaataccccagcgaccacttggcggtgggcggcgaggtggtgctggtggtgtag

SEQ ID NO: 158 - DNA, 2463 bp, Chlamydomonas reinhardtii
atggcggatggcggcgccgccggccccaccagccgccgcccgcgcctggatgttgacacgtggaccgttcagctagaggagctgctggcgctgcaatcggtgtacgaggatgacatcagcattcttgcggcgccgggggctggcgcggccggcgacggccccagctgcagcgacggcagcggcgcgagcagtgccccggcgggcccgctgagcgccgaggagctgcttgcggcggggccgccacccgagctgctgctgccgccggacgaggcagagggcgctgactctgagggcggcggcagtagcagcagctgtgggtgcttcgtggtggaggcactggtgcacgtggacatgccggagggagggctgcagttgctgattgagatgccacccatgcggctgcagcagctacagccgcagccgccgcagcagttggcgcctgtagcagcgcctgtgacagccacgggcaccgctgccaacgcaggctctagcgctacagtcatcgcggcagccgcaggggcggcagtagccaatggcggcggcatgtctggcgctgggaagggcgccaatggcgcagcaggcggcggcggcggcggtcgcggcaggggccgcggtgacgccagcgcaaacggcacctcgcccgacaagggcgggggccgtggtcaacagggtaggggcagcagccggggcagcggccgcggcagtgggcgcttgcgcagcggtgacgcgcacgccacctcctcccagacaccttcaccgccgtccaagcaccagccggcggtcatgccggcgccggcgacttatgaggagcagccggcagctgtcagcggcgtcaaggcggccgtgcaggccgcggcgccggtgctggtggtggcggagagcagcccgccagtagctgccccagcagtggcagtgccagcggctgtgccggcacacccggcggctgaggcggagggcgagggcgtagttgaggcggtcgtgactgggcagcaggcggcggggcaggagcggcatgaggcgccactgctgatgccgttcggcggcacgctgcacttccttagccccatccgcctgacgctcacgctgccgcccacctaccccgccgtccacccacccgagctggacgtgcaggcgctctggctgtcggaggcgcaggccgcgcagctgcgggcggcgctgcgggcgcagtgggcggcggcgggccccggcacgcccatctcctttactctggtggactggctgcgaggcgaggcgctggcggagctgggactcactggcggcagcggtggcggtggcggtggcggtggcagtggagggaagctggtgctgaggcgcgggcagcagcagcagcagcagcagcagccggcggtgactggggcggcgggggcagcagcaggcggtgccaagggtggtggtggcggtggtggtcagagcctggaggcgctggcgatggcgctcgtgcgctactcagcgcggcgggagcagcacgtgttcgacgagtcactggtcagctgccccatctgcctggaccagcagctgggctcccgctgcgtgcggctgcccgagtgccgccacgccttctgcgttgcctgcgtggccacacacctgcgcacgcagctgggcgccggcgcggtggacaacatgcgctgccccgaccccgcctgccgccgccagctgccgcacggcgcgctgcagcagctgctgagtgccgccgagtacgaccggtgggaggcgctgacgctgcagcgcaccctggacaagatggaggacctggtgtactgcccgcggtgcagggagccgtgtcttgaggacagggatcactgcacgctgtgcccctcctgcttctactccttctgctccctgtgtgaggaggcgtggcaccccggcagccggtgcctggacgcggatgccaagctggcgctgctggaggcgcggcgggcgggccgcggcgaggcggcggcgcgtgagagcgccacggagcgggctcggcgcgaggtgaacaagatgaacgagctcaagagcctggcgctggtgcagagctccaccaagcaatgcccctgctgctccatggctgtggagaagaccgagggctgcaacaagatgacgtgcgcctactgcggcgtgtactggtgctggaggtgctgcaggatgatcaagggctatgaccacttcaaggaggacggctgcgagctgtttgaccaggtggagatcgaccgctggaacgcgcgctggaacggcggattgtttgaggctccccggcgaaacgaggtggaggataacttggcggcgttgcaggttgcccggcgcgtcggccagaaccttaaggagggccgcaacaacaacatccgctgctggtcctgcaacagccacttctgctacctgtgccgcacgtggctgcgcaaccggcccggcgcacacttcggcacgggcgccggccgctgcaagcagcacaccgacgactga

SEQ ID NO: 159 - DNA, 1185 bp, Chlamydomonas reinhardtii
atgcatttggcaggctctcgcagcgtgctcgctgggcagcgcgttggtcgtcgcacctctcattgcccaactgcctccaccagcgctgcagtcgtcgcgcaggcctgccctcacgtaacgaccacagccataacctcgcgcacctctagcgccatctacgctcatcgcgccacaacctcgagttcgctgggcacccgccaccgccatgccgccaccgtgcgacatggcaccggcgtcggcatttcggcagccccccgctccgccgcctcctccgcctccggccgcctgctgctgctgcgcggcgcgggcgcagcttcggcagttgcgcaccgcggccgcggccgcagtggagtggctgtagccgtgtccgccaatctgtttgcccgggttgcgcgcatcgtgaccagcttcttcaacggcctagtcgggagctttgaggatcccgagaagctgctggaccgagtggcggaggagatgcaggaagacatgatgcgaatgcgccaggccacggcccaggtgatggctagccagaagcagctgagcgccaaacagcgcagcatgcagtccagcgccgaccagtggctgcagcgtgcggagctggccgtggctcgcggtcaggacgacctggcgcgggaggcgctgaggcggcgcaaggtgctgcaggaggacgcggaccgcatgagcgagcaggtgaccctgcagacacaagcgctggagcagctgcaggccaacatccggctgctggagggcaagctgggcgaggcgcgctccaagaaggacacgctcaaggcgcgagccgccagtgccaagacgtcgctggcgctgcaggagatgatcggcgggctgcaggtccggtccggcagcagctgggccgcgtttgataagatggaggagaaggtggctgcgctggaggctcaggcgcagtccgccgccgcgctggccgcgccggactccctggagcggcagtttgcggcgctggagggcgacggcggcgtggacgccgagttggcggcgctcaagcaggcacgccgcagctaccccgcccccgcacttccccgggactccacggccgcgccctccgctgccccctcgtcggccccgcacgtggcgggtcggccactgcgtgacgtgtttgacccgctggagagggagctggaggagctccggcgccgggcgcgggagtga

SEQ ID NO: 160 - DNA, 1560 bp, Chlamydomonas reinhardtii
atgacggattcactcgccgcggacgcagcgaacgttgtgcgccggttcctggagacaggcgcgcccacgtatcccggtcccacgcccagcccatcgccgagcccgagcccgagccccacgccgacgcccagccccagcccatcgccgccgctggtgcaggtcgtggagaccgttctgaacgtgtcgtatgacctcaagtcggtgtcagcggagattgtcctcaacagcacagaggcggttgttggcaccgtagtggacatcgttgccctggtgcgcgaaagcattgcgaagactctcggcattaacttcacgcaagtcgtcattaaatcagtgtccgcgcgcattaacggcgtggaccaagtcatcgcgggggactggaacactctgcggcggcacctactccgccgcatggccctggaagagctccccgcccccgcccgcagcctggcagactccctgcccgccctgcacggcgcgcccggcgaggtctcacactgcggcaagccccgccccatcagccttgccgaggccgagcgaatgctggcgcagggctcggccctgacgtactcgtacgacgcgcgccgcatgcttcaaggatccggatctggaaactccttctctctagacgccatcaacattgacctgagcgtcgtgcagtacgtggaggtgccggtcgagccgtccatcccgccgcccaccaccaacggcaccaccaacggcaccaccaacggcacctcgccctcgccgctgccgcgtccctcgctcatccccatcaacaccacggcgctcacgcagattctcaacgccaccaccatcaatgccaccgttatccaagcgccctcgcccacacccacacccacacccacgccgccgccgcgcgtgcttttcgctcgcttcaagggtgccatggccgacggagtctacaccaagggcctggagcccgccaacgcctcgggcgtggcccccttcgtcatctggcgcgaggacgcggactttgacaactggcgccgccctcgcaaccgagccaacctggtccacgataagcacctgagctgcggcgccaacaccgtgggcacctgcaccacctgccctcgcgcctggcaggtcggcgccgacagcaccaacgccaccatcctcttccgcgagccgatgcagcttgaccgcattatcatcaagcagctccagaatcctggcgtgctgaccgtccagctgctgccctggcccgcggtgcgcatccccggcctcaacgccaccgcgcgcaccggcaccctcggccggcccatctggtccgtgacctccgacagcaccccgtgcggcggcagcctcaccatcccgctcggctcgcgcgccggcaccggcctggccgtgcccaagcgcggcagccagtcgcttatcccccgcaagctgcgcagcaccaccgtgggcggcatcagcatcattgtcaaggcccagcccaaggactgctccaaggcccccggctgtaccttcattgagtcggtgctgtttgacgggcgcgtgctgtacccggccgaccccgccgccgaccccagcactgtgtaa

SEQ ID NO: 161 - DNA, 714 bp, Chlamydomonas reinhardtii
atgcttgcccacacgaaccttaccagctcgggcgcgagcacggtgcgcccagctcataagcgcttccatggtcgcgtctccgtcgttccacgcgctgctgcgggtgcccccgcggccatctcggcggccacggatgcgctagcgaccctccggagcgcggcagccaagcccggctctgttaagccctcggacgtgctggcagcaatggtaacggtggagaaggcgaagctcaagccggagaactgggaggccaacctcacggcgccaggcacccgctggcggctcgtctacactgtgtccggtaaggacctgaccgctgcagccaagaagcagaaggccgggtcgggagcctacttccccatctccgcatgccagaaattcgacgacacgggttttgagaacggcgtgttcttcgggccggtggccaacctcaccttcaaggggccctggcagctggacgcgaaagtgtgtcacttcgacgtcaacaccatgtacctgggcctgggcccctggcgcctgcccatcaagctcaaagatcagacgccgctcaagcagatggccaccaaggagtttaaggcgctgccgttcttcgtgtacgcctacgtgggggaggacattgtggtagcgaggggtcgcagcggcggcgtggcgctgtggggccgagccgacgccgcctggctggccacctcgggagccatgcaggtgtacaagtag

SEQ ID NO: 162 - DNA, 19203 bp, Chlamydomonas reinhardtii
atgtttgagtcccaggttgcgtactacctggatcgataccttggccagtacctgaatggtctggatgcagcggcactccgaatttcggtctggcgtggcgatgtcgagctcagcaacctttcgctgaagccggaagcgctcgcggaccttgacttgccagtgacagtcaaggcgggcttactcggaaagctcacgctcaaggtgccatggaaggcgttgggtcgggagccggtcgtcgtggagtttgaccgcctctacatcctagccggacccaaggagcagcagagcgcgcagccatgcaagatgtccgtgtcagagtacgaggcggagactgtggctgcggagttggaggccaaacggcgccgcgtgctggcggcggagacggcatggctgcaggagctgcaggccaagctggcgctcaaggcggcgcagctcaagggccagctgcagaagcaggcggcggcggccaagtccgagggcggcggggggctgttcaacctgcaggcgctgatgcacacggtgctgggcaacctgcagctgcgcctcaccaatgtgcatatccgttacgaggacgggctgtcgctgccgggccagctgctggcggcgggcgtcaccctggagcgtgtgtcggcacacacggtagacgaggccggccgggagaccttcgtcacgtcgggggtgcttcagctgctgcgcaaggcggtggtgcttcaggagctgggggtgtacttcgacgtgggccgccccttcttggtggcgccccgcgccgactggtcctcactggtcatctacgagtgggacgcgctgttcctgcccgcacgccacgcccccggcagctctgtgcacccgcaccacttcctggtgatgcccatcacgggactcatgaactacgtgcgcaggagcagcaagacgctggcggcctccgccagtgccgcgggcgccaccagtgccgcggggccactgcccaagcaggagggccgcattgcgctgcgctccgtgagcctggcgctcagccggcagcagtacgtgggtagccgggcgctgctggagacactggaccgctacacggccaacagcccatacagggccatcaggccaaagggccggccggcggagggcgaggctgcacgtgtgtggtggcgctacgccttcttgggggtgcgcacgcagctgcggggcagccgggtggcctggacgcagctgcgcaccgcctgcctgctgcgcaaggcctacgtgcccgcatacgtgcgctgcctcgaggcggcgtcagcggcggcggccaagggcagtggtggcaagggccagggcgccgggcagccgggtgcgcccactgcgggtctgggcggtgacgcggccattgcggctatggacgcgcagctgccggagagcaccatcctgctgttcaggcgtatggcccacgctcagctgcagctgaagcaggagaggggcggcaccggactgccctctcgcggcgccagcaccacctcgtcgtccgcctcactgctgcagcagcagccggggcagcaggccgctgcagcgccagctggcgcacctgccgcagcgcccgcacaggatcgcacctggatcggctggtggcgcggcaccaacaaggctgccgcagcggcggcagcagcacctgcctcgcccggcggtgcgcccgcttcgggctcggtgtcgggcgggtcggaggtggtgatgggccccagcaccgcgaccctcagcccggaggagtggggccgcctgcaggagctgctgcagcagcaggagtttgcagacgacgacgacgacgacgcgggcggtggtcgcgacgggccctacaccctgcgcacactgctggaggtggctgtggagcgggcctccttggagctgaggggcgaggtggggcaggtgggcgcagtgcccggcaccgaccggccgcggcccatcctgctggcctccatgcggggcctgggtgtgcgggtgctcaactaccccaccgccctggcgctcaacgtgcggctgggctgggcgggcgtggaggcgccgcagggcatgctgctgtgcactggccagctgggcgcggcggaggggctgggcatggggctaggcggaagggtggcggctggaggcggcggcgagggaggcgctgtgttcggcggtgtgggcggcgggctaggtcggtccgggccgcccacccgcaccgccacacccgctctgcgatccagcactccgggtgggtcgttgaagccagtggcctccagcgccgcactgcccgccacagcaccagccgaggcggacgggcgggctgcagcccagccgtctgagccgctgccgtgtgccttcatgctggacttcatgaggcggccgcaggacggctctgctgacgcggtggtgagtgtgcggctggcgcccagctacgtcacctacaacggcgcggcgctgcgggcggtgggcgccttcttcagcagcagccagcaactgggcatcggcacgctgcaggcccaggccgccgcccgcgccgcccagctgcagcggctggcggccctgcggcttaaggcgctgtcggccgagcggccgcggctggcggtggcggtggtgatgcacgcgcccaaggtggcgctgccggacagcaagggtcgcgccacgctgctgctggacctgggctgcttcagcctcagctccgccacacccgacagccagggcctagctgcggacggcgaggaggcgggtctgtacgagtgcttcacgctagggcttgagcggctggaggcgggcctggtggggggagcctttgcatggccctccacacagccgccgcaggatgaagacggagacgatggcgccagtggcgacggcggtttggctagtggtatgacggctgcggccatgacacggtggggccccgccgctcgggcggtgcagacgggcggggctgcctcggacgcgctgttcggacccataccgcagaagccttcggcggcagcggcggcggcggcagcagcagcacagactgcaagccgcgagcagccgcagggtctggctatggttgcgggcatgactgccaatgaggaacaagaggcagcggcagacgattcagcggccggggccggccgcacggagtccccacagccccgcaaaacggccagtcgggcgagcagtgcgtgtggcagtagccatggaggagggacggaggaggagggcgaggagggcggtgctgcggtgcccggtgtagccgacatgggccatcacggtggtctggcggacctgttgcgtcagctggcgctgcaccgggcggcggcggcggcactgcagggcaagggttccgccgccgccggcgcctctgacgagcctccacctgagctggtgccgctgctgtcccgcttcggcgtgattgcggcgctgcaggtggccactgcgccgcacccccggctgccggctgtccgcacccggctggaggcctcgccgctggtgttccgcttcagcccctggcgcttccaccgcctcatggccgtcatcaacagcctggtggcctcactcagtagcggcagcagtggcggggggacaggcggaggcgcagccgacggagcggccggctgcaaagaggcccttcaggtgcggctgccgctgtgggtgacggacgccgagtacaccgcccccgtacagctgctggtgtgggagggggtgggcggtcgggtggccaagtggcagccccggcagctggtggtgtggcgcggccgcgtgtacctcagccgcagccccggcagcggcgtggtgtctgagagccgcagctactggcgcggctggcggctggtggagctgccgcccgaggaggtgggcggggccgagtgtgcggtggcgatggtgccggagggcgtgcggcgcgaggcggcggcggaggcgcctgagggcctggtgctgcggctgtctgaggcgcggcaagtggctgagctgcgccgcaatatgatgcggtcggcggccctggtggaggcggtggcgggatacatggccacggacgcgcacattgagtcgcctgactcacccaacgccacgaccggcacagcagcaggcagtggtgtgggcggcagcggctccgtgggcgtgactcgcgacctgctggatgagctgctggcgcacagggacgtgttccagctgtccggacgactgcccgcactcacactcaaggtgtcaggcaggccgcccagggcatggagggctgttcggcggctggcggctgcggagccgctgtcagcgggtggcacggcagcggctgctggcggcacgtacggcgatggcccggggccagctgcggaggtgctgggaaacatgtatgcacagcagcagggtcccgagtcacacgctggcacggacgtggagggcagcgtcgccggggcccgcggcccggtcggcaccaccaccggcactggcggcggctccacctcatcgctcagtgaggcgggggtgccctccgcgcctgcgtctgtgctgtcagcctcggccaggaccacccgatccagtcgcctggcgggtgggggccagctgccgccgcgtccgccgccgtcagtggcctgggggccggagggacctggcgactcggcggctggggggctggcggagccggacgcggacccgggggagggcggcggcgaggagggcgatgatgctttcgaggacgcggatgactacatggatgaggaggacagctcggaggcagatgaggatgaggaggacgaacgattcagcagcgacgccgccagcggacagcggagcccgggccggcggggccacagcactgccgtcgccgctctggaggccctgcggcacctgtctctggaccaggagacgccgctgctgagtgtggctctgactgaggctgacgtggcgctgcagtacagcgccgaccgactggcggtggggctcaccatgcaggcactgcgcatggaggatgagctcatgggcgccgcactgggccgccagttcgcagtcatggcgctgtcctcctcaggcccgaccgcgccgccagcatcagctggggccaccgcccctggcgctgaccccgccggtgctgacatccccagtgagtcagcgcacccatccgccattaactggcagccggtgcccatcaccaccgcgggccaggatgccagtgccggtgccgccagtggcagcgctgggcctgccgctgtggcgccgctggcgcagttcagcttcatcagcaactcctccagctccgaccgctacaagggtctggactcggagctgggtctgcagctggcgggtctgacgctcatgtgccaccgccccaccatcgccgctctcatggggctgggctcggacatggggtacgccaccgcgctgctgtccgccgagagcggcacgcagcagcaggccggtgccgcgcagcttgccacatctcctgcccctcctgctacggctgctggtgctgctgctggcatcaccgccccggcacagggcgcaggtgcaggtgcaggtgcaggcaacgacggccctgttcgtgcgggcggcgatgggcgcacgctgctgcggctgcacatcagcatgtcccgcctgcagctggtgatgccgtacgaggtgctcagcgcccaccagcgggtggagccggggctgacgcaccagcaggtggtgctgacgccgcggcagttcgcacaggcggccatggacaattttagcttgcgactggacgtgcggccgacctcgctggagctgtccaccagcctgggcaacttcacagcgcagtacggcgcactggcggaggagtcaccgtacaggaccatatgcagcctgcggccgggcagcagcgcgggctcgctgattgaggtggtgttcaggatgcactctgccgcggaggccgccgctgagccgcgtgtgccggccggcgccgcctactcgtccctggtggcccggctgagtgcggtgcaggtggtgtacatggggcgcttcctgaccgagctgctggcttacataaatggtctgctgtccatgcagccgcgggcaaggccgcccctcagccccgccacaccaccggccccagccgccactccggccacacctgcccccgcggcgccggcgcctgcacctggcgcccctgcccctgccgccagccccttcgtgctgctgatggacgtgcaggcggcggcgcccgtcatcaccctgccccagagcagctccgcggcgcaatacctcaccgcggacctggggcacctggtcctgcgcaacacagtgggctggaggcactgcggcggcgcggtggcgatggcgggagctggcgccgcgccaggcgtctccgtgcccgctgtgtcggatgccactggcgccggtgtgcggccgctacccatggtgtcaggtggcggcgctccaccctccgctggggacgccgtcggcagcagcgacagtggcggcagtggtggcggctggcgtgtgctgatggacgagatggtggtgcggctgcgggacatgagcctggtggtgggggcgggtggtggggtgccgcccggtcagaacatcattcgtgacgtgggtccgtccggccttgggctcactctgtaccggccactggcaatcagtggcggcggcagtgacggtggcagtggggctggcagctcggaccagccagctggcagccgccagccgcccatgccgccactgcatgcggcggtgagcatcccccggctgggcgccgtcatcagcgagctcgagtaccgccggctgctggcggtgctgtcaggcaacttcgctgagccgccagtcaacgacccccgagtgctggagctgcagcagctgctggccaggattgctgcggctgccgccgcggcgccacccagttcactagccccgcccgccagcagcagctcgccggctccccaacccagtggtgcggcacaggcgcagcagcagccgcatccacccaaggcggcggcggtcggcaaggcgggcgctggcggctcaggctcagctgacggcgcctccgccgcggctacccagcactccaacagtctaccccccagccggcggcctgtgttcctggacttcaaccgctccatccgctccgtgctggaggcgctgcaggacacctgcacagtggaggccaccgtgtctctgggcagcgcccgcctgacgctgctggtagaggcgacggacggcagcggccggctgctgcccctggcctccctgggcctggcagacctgtggctgggctactatgctacctcccgcggtgccatgtgcctcagcctggcgctgcccacgctgcaggttgaggacctgcggccctctgtggcgcccgagctgcggctggtgctgtccactcgctccacggcagcggcggcgctggcgtctggcggcgtggtgtcctctgcggccctgactgtgccggccatcagtggcctggacggcgccggctccagctccagccagctgcctcagccgaacccctcccttctgaccctggagtaccgcgccgtgccagccggcgtgatgccgcctctgccgccctccggcagtcagcagggagccaccagcaggggtgccgcgccgctcggcggtcctgctgcctcggcgccatccgctgcctctggcccggtggcccgcagccccgccgccactgcgctgcggttgcggctgcagcggcccaccgtggtggtggacttcaacgggctgctgctgcgcctggtgaacttcgtagcccccaatcccgtgttccagggcccggcgccgcgaccctttgagacccgcgacctgctgctgtcgccctccgccccctacctggcacaaggccgggacctgtggctgtcgcccgaggtgcggctactggcggacgccccgcccgcagccttcacagggccacagggcgcagctgccggcagcgctccggacactggctccggcggcgcccccaccacctacccgggcttcagcagcggcggcagccacatccacgtgtatgatggtggcggcgggcggctggtgctgccgcccgccctgccgccctccgagttcctgccgctcattgtggtgggcgcgggccgggcgctgcagctgcgcaatgtgcgcatcgtcaactgcgcctcgctgccgtcggtgctgcagctgggcgcgggggcgcggctggtggcacgtgaggaggacggcgtgaagatgctgctcgcggcgccggatgcagacaaggagtacgcggcagtgctggcggcggtggcggcggcggccgaagcggcagccgcggcgtccgcagcggcgacagtggcgggtggcacggcagcacaagcatcaggagggaccagcctgacagcgggcgccagtgtgccgtcaccaatcttcgaggtggcagtggaggcgctgggcgcggcaatccacatggtgggcagtgacggcgccgctgacggaggcctcggcggcccgggctcggccgccggtgcatcagcaagccgcggaggttcagctgctggcagctacagcgccaccctgagcgctgctctaggccagactgtgggctccggttcgttggctgcaggctcaggtgcagccggcgcaatggaaggtgcagatggcaccagcgccgtgcccaagacggtgctcaaccgtagcactactgacctcgcagctgccgctggcgataccggtgacggcgctggggtgggcatgggactaggatcagcgtttggaggcgtgggcgctgctgcggccaccgcggccatcctgtcctcccagcggctgcggcggcggctggtgctccagctggatgtgtccgccacctaccgggccgggggcagcgagcaggtggccgcggctcagttgcgcggcctcaccatacgcacactgaccacctttggcgggactgatgtgggcggcgggcttgtgcgtccggcggctggtgtcaccaggccaatgccgcccgcctccgcaccgctgtccaagaccgacagctcggccgcccacctgcccgacacgccgtcaggatgcgcagcaccggggccccagcccagctcgtcgctccgtgcgcccccgctgcagccgctgcaccatctggagcaccaccaccggtccgcctcactgaacaccacatacgccgggccggtgctgcccacccggtccactgccgcctcctactccgccggcgccgtggtggcgtccgtgtcggccatgctgctggagcccacggacgtgtccctgcgcttctccgccaccgccgcctccaccgacctgtccctggactgttccagcctgtctctgcggctgtcgcccgccggcctgcacctgctgctgcagctcaacgccggggccgccacccagctggcggtggcgcggccagaccagccgttggcgcgctgcgaccgcttcgagcgcatgtggggcagccacgacgccggcaccggcaccggctcgggcggcggggccacgccgttgcgtctggagctgggagtgggcggtgtggacgccatggcctcggagcgcggcgtgacggtgtggcggccgcagcccccactgggctatgtagcgctgggcgacgtgctggcggcggcccctgcagccccctccacggcgctcaccacctcggcctcggcccccatggcctcccacttctccgccgatctggacactcggcttggggcggaaccggacgtgtgcgtgtggcggccggtgccgccgctcggctacgtggccctgggctgtgtggtaggctacggggcctcgccgcctgcactgggcgtggtgggctgtgtggctgctgcggctgtagtggagtcgcggcttggcgagctcctgctgctgggcgagggcggtggcggcaactggtggcgggtgcagaacgcggcttgcacattcgaggtgtcgggggcgcctgagggcattgctggtggcggtggtggtggctacctgccctctgtgccggtctacgacctccgctcgccactgggtgtgcccccggccgccctggtgccactgcctgggctgcttcccttcccctttcccggcctcatcgccaccgaccacctgggccgactggtggggagtggcgctagtgcgggcatccccaccgccctcagcacggtgctgctgccgtcgcaaggcagtatgcaaccagctgcaggcgcatcgggcggtatgccgaggcccggcaccaccgcatctcccccggtggtgcccctgggtctgatgcgtcagggcagtgtgccgctgggtgtggtgaccggcagtgcgccgccgctgtccctgctgtgccagcagcgctacctgaggtccaggaggtcccagattagccgcgcggtgacccaggcctcccaggtgccgtgtgtggagttcaagaggatttggtgggacaggaacctggcgggggcggggccggccgcgccctcacagccgcacagccacctcagcatatggaggcccaggccgccagcgggctacgtgtacctgggcgacacggcagtcaccggcatctacgcgccgcccacgtcggtggtggtgctgcgggacagcgacccagcggccgcactcacagagggccgcccgccgccactggcccgccccatcaactacgtgcgggtgtggcatgacgaacaccgtgagcgcctgggcgaggacacgtatctggtgctgtggcgcccggtgccgccggcagggtatgtgccgctggggctagtggcgcgagtgggaccggcaccgcccgagccaggactgcccatccgctgtgtacgggccgacctggtagctgcggacgagctgcagcgcgcctcccccgactggttcgtgccggcgcacaagcagcgcatgccgctgtgcggctggctcacggaccgccgcaccggcaccttcacggtggtggtgcccacgccaggagccggcggcggcgcgccagctgcagaggggggcggcccccgggcagcggctgcgggcggcgtgggtgccggcggtgtaggcgccatgctgcaggtataccgcatgaagctggatgcggatgacgaggcgccacagccgccgcatagcacaccgtcgggccccggatccggcaaggcccaggcgtcagcttcaagcgcgtcagactcgccgtcattgccgcccgtttccaccaacctggagctgcgtctgggccgggccgcagtgacggtacgcacgagcctgggccgccccctgcttgagctggacgtgcgggaggcgcggatggggctgtgcacacagggcccagacgtcagccgcgggttcgccttcctcaccatgtccgcctggacgcactcgcccaccctgggcgtgtgggagccgctgctagagccctggcagctgttggctcacgtggatgtgaaccgcgcctcccggccccgcggcggtgtgggaccgggcacctgggtgcgcttcacatccacacagggctcggtgcacgtgtccctggccgccagcgcattgcgctcactgctggacgcgctgcccgaatggagcagtctgacggggccggagggcgtggccacggtgcggcggcagctggcatttggtgaggcaccagcgaatgcgctgggcggccaggtgggcagcagcggcgcgggcgggcctgccctgcagcaggggctggtgaccaacgcactgggctgcgaggtggcgctgctgacagacctcggcgatagacaggctgtgtcggagctggcgccggatgctgagggagtgccggtgctgctggcgccgccgcccgccgcgtctgctgccgcggctgctgctgcagagagccgcgccaccaacctggcgcctcctccagtgcccgccatccggctgctggctgatgcggtggccgcgaacgggctgtcgcctgagctgatggcggcaggggctctcatggtccgcataaaggtgaacggccccgcggcggagctgatgcccgagaccgcctggggcctgtacacccgggcggtggagacggccccgcctccacccctgcccgccccggcagcggatgaccccgatgatgccacgtgtgacacgcctcgctcctcagccgaaccctcttcggctgcctcgggagtggaggtggtgtggaacgagcgctttatcctcaagctacctgtggagctgagtgagcagctactgtgccccgcgcctggagacaaccagtttgccggtgtcccgctgcagctggacgtgtctctgctggcatgtggctccgcgggcgggccgccccgtgtggtggctgccggcaccctgccgctgcagtccgactggttgaccaacgaggtggacatcctgcgcaacacggcggctgcagcagtggcagccgccacagcggccggcatggcggcccccctgctcaacgagggcggggtcatcaactcggccgctgctaccggcggcgccaccggctccgtgaagccaccccagccctcgtccgtgagcgagacgctggatgtgcccctgtacctggtcactgtgcagtccggcagcagcaggcagccccgcacgcagcagctccagcagcggcaggcgctgggcaaggaccgggggccgcaggagtccatggcgctcaagctgcgtctcagcctggacgtgcagcaggtggacagcagttgggcgcccttcctgtccaagtcaaggcgaggccggccgggtgccgggggaagcgcagcgtcagcagcgctcagcggggcgggtggggcctcgtctgcggttgctgcggccgctgctgcgcgcggtgggcgacgggctatccggctggcgggtagtgatgtgtgggtcccgttcaaccagacaggcggcatcatcacggcgggtccgggtggtgacacgcttcaggcatcaaacacggtgcccatccgtgctggccccggcctggtgctagagcgcaccccgggccctggcggccagcccctggagctgcttcgctcgctggctgtcctgcacaactgcaccagtgtgcccctggaggtggcgctgatggcgggagaccccgaggtggccagctggatgctcctggcggacacacccgcgtccacgtcatcagccccaggccgtggagctacaggcagcaaggggtcccgtgccggcccgcctgcagccgccgctcctgccccaccggctggcagcctggcgcccgtggatgaggaggtgtatgagaaccagcgctacatgccgctcaggggctggggcgcgggcaacctgctgcctacggagcgcaagcgctacagccgtgccggtcacagctacagcaccttcccgctggtgccgctgccgccgggttgggaatgggaggggccgtggcaggccgagacagcgggccatgtggaccgcgacggctggttctatgccctggactggccgctgctgaggtacccgcccacgccggagcaggcgcggcgcaaggtgaccgacctggtgcggcggcgccgctggttgcggcgacgacgctgggtgggtctggccggccgcggcaggctggacagcgctgcccggcggctgctgggcactgtgcgccccggtgagcggctgccgctgccgctgggctgggaggctgagggcgtggagctgcaggtccggccggtgctggagctgccggcggagcccactgagctgcagctgccgccgaggaacccggcaagcgcggggccaacgggcggtgacacaggcggtggcggcggtggtggccacgacatgactgttgcggaggtcaaggcagtgcacgagtggagctgcggccccacgggccagagcggcctgctcatgacgtgcatggacgagggcggcgcccgcctgctgtgctgcaggaccactgcggtgccgcagcagggtgcggaggatggcgccggcccgatgcaggctggggcggtagggccagcagctgcggcagcagtggccgcggctgcagcaggcggcgctgcgtccgccagttccgctgccaacagtgcgtttgcggacctggccacaatggcaccgctgtccgcggacatggctgtggctgcggggcagcagcagggcaggcagggcgagttggacccgggtcaagccgcctggctgagcgtgagcctggagtgcgaggcgctggtggccacccgggcgggccttaccgcggctgaggggggcgctggtgcgccaggcggcctggacaccctggtggactggcgcctggtggtgcggccgcccctcacactgcacaacacactgcctgtgacaggtcgctacgtggtgtgggagcggccgcgcacgggtggtccgctgcgtgttcggcagcagggccgtgtagctgcaggtgccactgcgcccgtctacaccgcggacatgcgcatgcaggtgtttctgtcgtttgcgcctgacggctgcgagtatggcgaggcggagccagtgctgctgagcgacggctttatgcgcaatacggcgggggtggcagccgcggcgcgactgcccgatggcttccgctgcacctacacgcattctgcctccttcactccgctgcgtatcaaccttatccgcgacgtcgatacctccgccgcctcggggcccctggcctcactcagcgtggctgctcgcaaccctgccgctgcggccgccaacacatctggcggtgcggcgccggcacccggcgaggccgtggccggcggctacccgctgactgtgtcgctgcacgtgccgctgtggttcgtcaacgccagccagctgccggtcagctgcggcgtcatggcgctggcagtggagcaggaggcaggcgggccagcacggtcggaggactcagccatgggtctgccgcggtttgggccagctgtcaacgaccaggtcctgcgcatcatcgacaccgaggccttccgcaactcgccccgacccaacggcgccgtgtcggtgctgccgcgctcactggagctgctgtcctacccacccggactgcccaacagcatcatctacggcccgccacccagccaggaggccggcaacgcggctgtgcaagtggccatcctgctttccatcaacggctcgcgctggacacagcccatctacttgccgcgacctggggagcaggcgcagccgtccaagcggggtgtgggtggcgtgctgctgcccaatgaccgcatgctcatccgcgcgctggccaaggacggctgcattcacgaggtggctctgcgcctggagcccgcgccgctgtccatagtggcggccggagcaggtcccggggcagctgggggcgggggtgcgggaagtgcgggcgccaccctggtgcggctggaccaccacctggtgctggccaacagctgcggctacccgctgacactgctgcagcccgatgcggcggcggcggagcgggaccgggaccggacacgtgcgctgggcagtccggtgcactgggccgctgccgccgctggccgccgcaagttctgtctggcgctgcctctggctggcgagacggctgcgtccgcctccgcctacgggctgccggccagtgtgatgtggagcgagcccatcaaggtggacctgcccggcggccaggacacgcaggtggccatcccggtgtactgcctgggtccggtggggcgctaccactcggcgcactcgtccagcccagccgcgggcgccatggcgaccatggccgccctggccaacatgacgccgcagcagcaaagggcgtttgagctgcagagggcgcacgtcgtggccaggcagatgtttgcagggctggtaggcggcgaaagcacaggccacgggagtggcatggaccgcgccgggagtgctggcaagggcccgcagccgcagggcagcggcggcacgggtatgctgctgggtccgggtgtggggcctggcctggcgctgttgtcgcagggcagcgacaggaaggatgccaagaaggaccacgaggagcagcatgccgccgcccggggcccgtcacggccggccctggagcccaacctggtccggctggtcaagagcactgacatcggcagcgtggagtttttggctgtgctgcttaacgtgcgtgtggtgatccgggcgcccggttgcctggtgctctgggcggcctcactgggcggcctgccgcagcagcttatcaccaacgcctcgccgctgccgctcatgtggcggcagtcgcacccgcgggcagcatgggcacgtgtggagccctacagcgctgtgtcggtttgcaggggcgtgctgggcgatgggtggggctcgccacccgaggtggaggtgcgcgacaccgagccccagagcgagaacatgctgcttctcacctttgacaccgcctcgacttccacgacaagcgctggcggcccgtcggtgcggggcgccggcgtgactggtccgctaggtgccggagccgcgggtgacagcggtcgggcggttctggcaggcatgctgcgtgttggcgccaaccaccgcgagctgctggctcaggtggcgcccgcactggagctggtgctcacccctgacggcctcaacaacctgccgggaggcggagcggcaaaccaggggctgggcgcgtgccgtcttgatgcagcgctgaggatcgcgccggctccgccgcccattggcccagcgggtgccgggccccgcgctcccacgttcacagggccttacctcacgccagctgccctggccggcgtgtctcgcaacaaccggggcgcggttgcgggcgctggtgccggcggggcagcggctgcgggtggcgtgggtctaaacagcagtgtgcaccttagcctggaggtgggcagcctggagctcagcctcatagatgggcggccggaggagatcgcggtgctcacgctggacgggctgggtgtggaggtgtccacggggcggtcggctggctcgtacgacttctgggagctggggctcaaggtgcgcggcgtgcagctggacgaccaaacgcccggctcagcctacccggtggtgctacagccgctggacacaaccgcggcggcggcggcggcgcgggcgggcagcggcgagtgcatgttcgcgctgtcctattgctgccagcccggtaagatgcgctacgctctcaactgccccatcatcgccgcccgcctcctgcctctgcgggtgtctctggctgagccgctggtgtggcggctgtatgggcttgcgctcagcatcgcaccgcccgcgcccgctgccacagccagtgcagtgcagccgcgcggaggcggccgacaccaggtgtcggccagtgacatgccgctcgccattgacctgatgtgggtggaggacctcagcctgcgcctgtccttccgcaccgacgcctccagccgcccccgctgggccagtggcggcttcatccgcctgggtctggacctggcgcagctggaggacctcgcgctggtgctgccgggtatcgagctggagcgcgtgaggatgccgcgctccctgctgctgcagcaggtcttcacgcggctacaggaccgcctgttctccatcgttctggcggtcctgcgcaattacggagtggtgggcggcctcagcaaggtgctggccgtgtcgtcacaggcagcagcgacacttgcagcggacggtgggggcagcggctcggcccgtggcggcgcggccgggggtgcagctggtggtggtgggggcggtccggccagtggcagcggcgaggtccgtaacctaggttccggtgtggtggagggcggccgcgccatcgcccgcgggctgctgcagggtgccatgggcatcatcacaaagcccgtggagggcgcggagcagggtggggtggcgggcttcttcgaaggactcgccaagggcatcgtcgctgcgcctgtgagcgtggtcagcggcactctggctgccgcaagcaaggtgacggagggtgtggacgccacgacgcggaatttacggggtgctgcagccacggctgtgggcgccaagaagctgggtgctgcacgcaagcgactgcagcgtgccttcacagggagcggccgttccatgattggtaccgctatcagctccaccatcaacagcaccataggcgccctgcctgtgcacagcctgatgagcatgagcggtcgcgccagcggtcggcctgacctccggctggaccgctatgaggagcactgggtgctgccggggtccgtggtgctcatgattaccgaccggcgagtgctcgccatgcaggcgccggagtttgtggcactgcagtcagctgtcctgtccggtgagaccacccatgtgacggacgtgcctgtgggcgacgccatggtgttgtggcacctgccatggccagacatgctgtctgcggagctggcgtggcacaacaggacgccttccacagccggcgccagcaaccctgcaggcagcaggtcggcggcttcagcagcagcaacctctgtcgctgcagccaacccgcccgtgggcgctggtggcggctctgtggcgatgccggctgacgggctgctgctgcaccgcaagtacagggcggaggacgagcagctgctgtacgatgtgcgctgcaggcccgggacctcccaggcggcggaggtgctctcgcgcctccaggaggtgcgctaccgctgctatgtgctggcgcggcagcaggagcgcggctggcgggacaaccagagcagtgtgggcgtgtcgccggtggcagcagcactggcggcaacggcgagcgggcacccaagcagtggcactaggaccacagctgctagcggtgcgggcggcagcatcttgccagacaccatgatcagccaggagttcaagctggtgtggcgctccccaagcacccggctggccagcagccgcgcagtgtccttctggcggccagtggggcctccgggctatacaatgctcggggacgtagtggtgttgggccgcgacccgccaccgcggcctgtgcgcatgtacaaggacgcaccagctctggctgctgctgccgtgaatgccagcggcagtggtgatgcgccagcctcggagggcccccgcttggcgcctcctgtaggctggaccctggtgttccgcgacagctcgcagccaccgctgacgctgtggcgaccggtggccccgcgcgggtacgtggagatggggtgcatcgcctggccggagattgaggagccaccgctgggcctggtgcgctgcttacggcgggaccttgcggctccagggcgggtcttcgagagcgcagtctggggagctgccagctcggacaatagcttctggcgtgccagtgtgtggcaggtggatgcggctgcaggcacgtttgtcgcggtgaagggcgatgcaaagccggcacccgcgctggtgagggaggcggtgttctaa

SEQ ID NO: 163 - DNA, 2676 bp, Chlamydomonas reinhardtii
atgccgctatcgctccagcctgcccgtcaagggcttcgagcgcctgctaagcaggctcagcatgcgcgctccggaaagccagtcctgaacctgccgcgcggcgccacggtggctgccgcgcggtaccggattattgaggacccgcccgccgcgccgccgccgccgccgcccgccgccgtcgtggaggcgcccgcgccggccgtggcggatgtcgtgactgccgcgccggccagcgccgccgccgatgcggctcccgccatcgctaaccccttcgccgccgccatggccgccgtcagcgaggcggcggagaaggtgaccgacgccgccaccgacgccgccgccgccgtcgccgacgccgcatccgatgccgtggacgccgtctccgacgtcgccagcggcgccgccgacgcggtcgtggacaccgccgccaccgccgccgcctccgccgcctccgccgtcagcgcagtgacggaggcggcggcgccggaggcggccgccgacgcggtgtcgtcggctgtgtcggacgccgccgccgccgcctccagcctggcggcgcagcgctacctggagatgaccagcaaggcagccaaggtcaagcctggcagttccgctccttccttcgaggcgccctccttctccatgcccgacttcagcggcgtgcagctgcccaaattcagcgcgcccgatctttccagcgtcaaaatccaggttcccaagatctccctgcccgagtccgccggatccgggtccggatccgagggggccggcgccggcgtgacgctacccaaggtcgagatccccagcttcaagctggatctggatctgccggagctgcccgacgtcggcggcgccgccggcggcgccgctgctgacgtcagcgccgccgccgccgcggcggcggcggaggccaacgccgccgtcagcggcgtcttcaacaccgtcagcgcctccgtcggcggcgcggtgtcctccgtcagcgccaccgttggcggcgccgtcagcagcaccagcgccgccgtcggcggcgcgctggcggctggcgccgccgccgtggacgccgccaccggcgggctgctggcggaggcggaccgcgagctggcgggcgtgcggcaggtggcggacaaggcttccgccgccgtgggtgccagcctggagggcgtgagtgcggccgtgggctcagccacagcggccgtgtacggagccctgcccgcgccggcgcaggtgctggcccgcgacctgggcgaggtggtgggcgccttcgctgccaaccccgcctccagcctggtgctggcgggcctggtgggggtgccgctgggcgccaaggcctacctggacaggtacggcggctacagcggcgacttggcgcccgccgccgtgaaggagctgctggcgcgggaggacgcgctggtggtggacgtgcgcagcgaggcgcagcgggcggagtcgggcatcctggatctgcgcaagagctcgcgctaccgggccgccgcgctgcccgccgactcggtcaccttctcgcccaagtgggccaaggagcgcgccagcgacaagcagctgggtgtgctgacggcggcgctcctgatcgccaacctgacgcgtgtctccacgccgctcaccaaggtggtcatcatgaacgacaaggatgacgtggcggcccgcgatctggctcgtgcggtgcggcaggcgggcgtgctgcgcgtgtacgtcatgggaggcggcttccaggcctggcaggctgcgggcctgggtgtggtgtcgggccggaccgagtacgacgcctcggcgctggcggtgttcgcggacgaggtggcggaggtggcggccgaggtgacgcccaagctgaaggacccggccttcctcaccaccgcactggccacctccagcctggccatctacgcggcagccaactaccacaccaccctgcgctatgtggcggtgtggggcatcatggctacgatctacgcccgcctctccaagtacaactcgccgcaggagttcctggatgacgtgcaggccggcctagccgccgcctccgccgccgcctccgccgccgccgccgcggccgcgagcagcgccagcagcgccgccgccagccgcgccgcggcgcccgccgccatcgctggcggcgctgcctccgccgcctccgccgccgctgcgccggccctggcggcgcccaagcccgcggcgcccaagcccgcggcgcctatgattgccccggccccggccaaggaggtgtcttttgacgccctggctgcggcgatggccgcggccggcgccacgccagcggcgcctcccgcaccggcgcctgcgccggccgcgcctgcgccggccgcgcctgcgccgcctgcgccggcggctgctcccaaggccccggttgccgcaagcgacacgaccgccagcgccgccccggccgccgccaaggaaaaatcgcctgcggctgcccccgcgccggcgaaggcggagccagcccccaagccggccgccgcccccgcgcctgcgcccgctcccaaggctgcggccccggcgcctgctgcctcgtctgcccctgcccccgcaccggcccccgcgccggcccccgcgcccgcggcggccccttcgtctgcatcggtccaggacagcaagctccaagtgaaggtgtcggtggccccggagggcaccgccagcaccagcgactaa

SEQ ID NO: 164 - DNA, 1719 bp, Chlamydomonas reinhardtii
atggagcgcaattacgcggggggctactctggaggcgggcagcccagcaacctcgtttcttcaggccggcgtgccggaaccgttcggaccggcacgcccgatgccgccccagcggcgggcggctacgcgggcgcaggggctgcagatgatgcggcatcgcaccaggcgcgcttcggtcggcgggcgtcgcccggagcctacccctccggcgggggcatggacatggagccgccccgcggaggagccagcggctacaccccatccgcggccgccggggcgccgcgcgcagccggcatcccacgctccggcgcggccgcaggcgcctactccgcctcacccgccgcgtcctcagcagcagcagcagcagcagcagcagcgccacccccaggggcggcagcggcaggacccagtagcaagctctcggggctgcagcgcctgaaggaggcggcagcgtctcgcctggtcagtcgcatccccagtggggggcggcatgcgcctgagtctgccgggtacgtgccctcagccatgacccaccaggccccggcccggcctgcgcccctgcgtgccggctctggcggcggtggcggcgcctcctcgggcacctctgctgccggccggccaccctccactggctcctcaggctacggctacagctccagtgctgccgccggtgcagccgcgggccggccggggtcgggccggagcgcgtccactggagccgcgcttggcgccggcagcagggcacccggggcgagcagcgggtacgggtatgggtccagtgcggcgggtacctcgtccacctcggcgagtggacggccgccgtcagggagcggtgccgcgtccgcggctgcggcgtctgcagctcgcccctcggccttggcgtcgctggcggcgcggcggcagcagacggcggagccggcagcggctccgccgccgcgggcgcctccggcagcggctccgccgccgcgagcgcctgcggcagcggctccgccgccccgcggcctttcaggccccatccgcgcgccgccgccaccagccccggcgccctcgtatggcggtggtggtggaggctacggtggaggtggtggctttagcggcggcggcggcggcttcgatgcgggtaccattccgccgggtgcggacgaccccggcccgacgggccccatggtggagtgcccctcgtgcgggcgcaggttcaatgagcaggcctactccaaacacgccaagatttgcgagaaggtgtttgcccagaagcgaaagccggtcaacatggcagctaagcgacttgagggctctgaggccgccaagttcttcgacatgcgcaagggggtgcccaagagcgaggccaagggggcggcagggccacccggcaaggcagcgcccggccgaggcgcgggggctgctggcgggacgcggctggacgaccggccgctccccgggtccaagatgcccaagtggaaggcccagtccgagcagctgcggcaggccatggccgcaaacaagaggatcgcggacgcggcggctcgcggcgtggacatcaaggatgtcaagttcacgcccacgcccgcagagcaggacgaccgcgtgccctgcccgcactgtggccgcaaattcgcggagctgaccgccgaacgccacatccccaagtgccgggacatcctggccaaacccaagttcctgggggcaaagagcggacgcggcgcgcacgtgcgccggtag

SEQ ID NO: 165 - DNA, 1626 bp, Chlamydomonas reinhardtii
atgccttccaagcgccctcgctccgggcccgccaatgtcaagccgactccaacggagctccatgaggctgtcttgaaatgcactctttgcaacaagctcatcgacccagtggatgactaccggttgctggactgcggcgtttgcaatcgtgacgacaattgtgtccacgaagactgcattggcacgtacctcaagaaggaaggcagggaccaagctcagaagacgggcttcaagtgccctactacacttgccaatgggaagtcctgcaagggccacatctccaaatcccatccccatgtggcaagcaatgagaagaagaaggaggcacgcagggccccatcacaaccccgccacaactcgaccccccatggtggtgccactaaggccactgccaagggctctgttgtccaggctgtcaaggctgccatgacacagcagcttgtggtcaagccatcatcaggacccagctccacccgcttctcccctccccttcctcctgcccaaccaagcaacaacttcacgctgggtgacttcttcacctgggcgttgcctgctgccccttctgccaccaacacaacgcctcctgcccctcttcctactaccacaacctcctgtggcaatgtctggctggatcgcacccgccaggcttatgccaagggcctgactgtcccccagggacaccaggcccagcaggtggtcagtgcagagacacagctcctgcagcagctgagcgagcgcagtgaggaggctgaggacgcggttagctttgactctgctaacgagagcctcactttgtccgccaccagtgacagcacctccagcggcaccagtgtctccgtccccagcagtgccaccttgtgcatgctgctgggcaacctgtccttggatgcgcccacactgctgggcagccctggcaaccttggctcccacctgccttctccttcaatggacaagccccaggttcaggagctggtggtgcaagagctggaccaggtcagcactgtcatctgcagcaaggtggccagtgtcaccaccatccgcaacctgatctgcagtggccagctggcttggctgacacccgtggccacagaactgcagcaggtcatgatggcagcggcaggtggtggccaggtgctgtactgcagcctcatcaatggtgatggcagcagcagccttcccaatggtgacacaactgaccccattgtggctgtgcagcctgtctttgagctctccatcacccccaccagcctgcccagctgtcccatggctttggacctgacccagaccatgggtatgaaggtggttcgtgacccttgcaccctggcctgctacaaccctgaagactgttttggccctggctacagcctggtgggcttcaaggtgctcctgcctgaggccggtgaggagatggagggttccaacagcagtgtgtccaagcagtctgtagtggcccagggtgtgcctatccgccgtagccaaatcctggcagcaggtggtatggccagtgccagtgaggccccccaggtggccattggtgccaccccggttagcacccagtccttcctgactgagtcagatgatgagctggctctagagctaggtcgcctgtgtggctgcagctgctga

SEQ ID NO: 166 - DNA, 678 bp, Chlamydomonas reinhardtii
atggccctggacgcgggtgtgatgtcggtgacgctggagtttgccaaggacctgaaggacgcggactggttcggcaagcaagacccctactgcatcatccgcatcggtggccagaccttccgcacgcgcacggccgtggacggcggccgcaaccccgtgtggaatgacacgttccgcttcaatgtcatcaacgagaacaacgtggaggtggagatcaaggacgaggacgtgggcaaggacgacctgatcggcacgtgcaccttctcgctcgccaaggcgcgtgagagcggcagcgaccgcatccaggcggctgtggtcagcaagaagagccgcaagcagcgcggcttcctctccatcgccctcacctgggaacccaacaaggcgctcaagcccaccgtcaccacacagcccgccgcgcctcactatcactacatgccccacgccgcgcccctgcccgcctactacgccgcacctcctgcctacgccgcacctcctgtctacgccgcgcccgcaactcccatggcctactaccccagccctgcgcctcctgccggctactacgcacccgcgcaggcgcccacgtacgcggcacagccgccgcctgccgcagctgcctacccgcagcagccgcagcagccgcagtacgcgttttatcccgctgtgcccgtcgggcactag

SEQ ID NO: 167 - DNA, 651 bp, Chlamydomonas reinhardtii
atggccctggaagccggtgtgatgtcggtgacgatggagttcggcaaggacctcaaggatggcgactggttcggcaagcaagacccctactgcatcatccgcatcggcggccagaccttccgcacacgcacggccgtggacggcggccgcaaccccgtgtggaatgagacgttccgcttcaatgtcatcaacgagaacaacgtggatgtggagatcaaggacgaggacgtgggcaaggacgacctgatcggcacgtgcaccttctcgctcgccaaggcgcgtgagagcggcagcgaccgcatccaggcgcctgtggtcagcaagaagagccgcaagcagcgcggcttcctctccatcgccctcagctgggagcccaacaaggcgctcaagtcaaatgacaacgccgccgccgcccacgcgccccaccaccagcagcagcactaccagcaccccccgccaatggcctacgccgccgcacccccgcccgcctattacgctgccccgcccgctcctgcctattacgccgccccgcccccggccgccgcctactaccccgctgctgcctacccgccggcacctatggccgcataccctcctggcgcctaccctccccagccttacccgggtgcggtgccgccgggccaccggtag

SEQ ID NO: 168 - DNA, 768 bp, Chlamydomonas reinhardtii
atggcagccaagccaggtagcgcaggcggtgcggccccaccaccagcggcacccgcgcccccgcctgtgctggagaaaaagaccctcgcggagagccggttccttcggttcgtgaatgtggactacgcacggccaggggacaatgccaagtcttcatggcaatacgttgagcggacaacgcgaaggggcgacgtagatgcggtgaacattttcgcggtcctgaaaaagaaggacggcaaccaccaagttctggtggtgaagcagtaccgtcctccgatgggaaagcataccatcgagcttccagcgggtctggtggacaaggacgagtcgcctcagacggccgcgctgcgcgagctgaaggaggagacgggctacgtgggcaccttcattggcgccacgggccagcaggcgctcagcccgggcctgaccaacgagaacatgccacagaacgtcacccgtttgcaagcaccatatgcatcccccccccatccttccatgcatgtgcctggtgcccgtgcttgccctctggactgccgcttcggagcacacagggtcaccatcttcgccgagattgacccggagctcccggagaacaagaaccccaagcagagcaaggaggaccgcaagatgggcatcacgcgggagtggctgccgctgaagaacctgcaccacacgctcgcggcctacgaggcgcagggctggggcgtcttcgcaggcctgtacgccgtcgcgcacgggttctacctgcgggaacggctggggttgtga

SEQ ID NO: 169 - DNA, 1017 bp, Chlamydomonas reinhardtii
atggcttttcttcagcgactaggctctggtattagggatggtttgtcgtcgttgctaggcggcaaagacgagggcaagaagcacgaagtgggcaatgcgtccccgcagaggacgctcgcaaaaatcagcagccgtggaaatcgaccttcttccgcggcagtggggattctagagagccacacgcgcgaagccatcgccacctacgtgcaggcgaagtttgacaagggcgaggcgaagccgcacatgttcacgcagttctggctgcaattccccaagctggaggcggggtttgaggtgctgcggcgtcaactggaggcgcacacgggcagccgcgacgggccgctgccgctggcgctgctgcggacgcatgcctccgactttgggctgccggcgagctgcgccgtggtgcaggacctgtgcagcaagtcggctgtgcacaagtgccgcgacctcgactttgtgggcctggtgatgctgttgctggtggcgcacctgacggagccggccgccacctgcgccagcctgccggaggacgtgcgcaccatgctggactgcctggagctggcgttcacgcacttcaacagcgcgcgccggggcaagctggacaagcgcgaggtggctgaggcgctccagtacgagagcgccaaggcgcacatcaaggagggccgcggcggccgcaccagcaaccgcctggcgcacaggctgttcgaggggctggactgggagtacgacaacaccatttcgttcgagaacttcctgcggggcatcctgcagctgatctcggatgagttcggggacgacgacggcgacaatggcgacgagtacgtggtgctgacggagacgggcgaggccccgccggacggcgccaagcgcagcggcagcgtgcccacgacaccgggaggcacggcatcaggagggtcgccaggagcggcggggcaaccgggcacaccggggcgggtgtggggtgcgagcgcgagcggcatgggcggggccgcggcgccagccaatgtcgcgtaa

SEQ ID NO: 170 - DNA, 957 bp, Chlamydomonas reinhardtii
atgtctaaccgcgacaagctcgcagtggtctacctggtcaccaacacacactttaagtccaccgaccgcattgcaatgctcgctgcctcgttacggctggcggaggcgcacgtgctgcccaccacccccgccatgttttacatcttcacctcccccgggtctctggtggagctgcggagggcgcttcgacccctgctgcgggcgtctgccgacagcggccacatgcaggtgctgccggttccggacgacagctggcagctgccggaggcgggcaacgacacagcctactggcacgggcattggggcaagcactatcgcctgatgggcgactggcggctgagcttcatgccgcgattcgccagggacatgggccaccggtatgtgatgcagctggatgacgattcctacatcatcggcaaggtggaacagaacctggtgcagctgtttgactcgcgcaacatcagtctgggggctcagaaggtgctgcaggactggccgctggtcacctggggcctgcccgagctggccaagtacttcctgttggcctaccagctgcagcccaccacactgttccagcactgccggccgcccgggctggacggactgtactcggcgctggaccaacagtcgctggatgcagacccggaggcgcgagtgctgggcagtctgttccccaacaaggccgtccctcgctcgggcggctgggaccgcaccatcctgaacggcaactgcgtcatgatcagcctggacttctggttcagcagcctggtgcagcgcttcgtgcagctgtgccgcgccagcggcgggtccgtcatgtaccgatggaacgagcaggcggtgctgggcatggtggcgcagatattcgcgagccaggagcagctgctcatgttcagcttcccgtacgcgcacaggctcaagtacaaggacgcgttgagagcaggaggcttaaagccataa

SEQ ID NO: 171 - DNA, 546 bp, Chlamydomonas reinhardtii
atgggactttggatatctaaactgtggtcgctgttcggggaccaagaagctagaattctcgtgctcggtctggacaacgcaggcaaaacaaccattctataccggctccaggttggcgaggtggtatcgacaatccccaccatcggcttcaacgtggagacggtaacgtacaaaaacatcaagttccaagtgtgggacttgggagggcagacctccatccggccctactggcgctgctacttcccctgcactcaggccatcatctacgtggtggacagcacggacacggagcgcatcggcatcagccgggacgagttcaaggcgctgctggacgaggaggagctgcgggacagcctcatcctggtgttcgcaaacaagcaggacctgcccaacgcgctgagcgacgcgcagattgcggaggggttagggctgcacgacatcaagaaccgcgactgggccatcttcaagacgtccgcggtcaagggcgagggcctgttcgagggcctggactggctggccaacatgctcaagacgcgccggaaatga

SEQ ID NO: 172 - DNA, 5004 bp, Chlamydomonas reinhardtii
atgggcttgtttcgccgcgcggacgggccagcagtggtcgctgaggcgcatcggcacataccgctgggctcaagcctggacacagaggagcacctgccctaccgcggcaactatgcctccacaacgaagtacacgttgcttacgtacctgccgaaggcgctcttcgagcaatatcggcgtgtggccaacatcttcttcaccttaatggcggcgctgtctctcacgcccttcagtccgctcaggccctggacatgctggacgccgctggtgctggtggtgggtgtgtccatgatcaaggaggcgcgggaggactacaagcgctacaagcaggacagggaggtcaatgagcggcccacgcgcgtgctggacaggaagaccggtgaatttgtgacgataccatggaaggcgctccgcgtcggcgacatagtgcaggtgtgccgcgacgagtacctgcccgcagatctggtgctgctatccacctccagcgatgagggcacctgctacatcgagacgatgaacctcgacggcgagacgaacctgaagatcaaggccgcgccggaggagacccgcagcctggaggaggccgacctggtgggcctcaacgccatcatcgactgcgagggacccaactcgcgcctgtaccagttcacaggcaacctgcgcctgcgggcgccgctgccgcccaccgtggtcgcagccatggcagcggcgcaggccatggcggcagcggccaaggcggcagccgccgccgaggccggtggcggggaaaaggaaaagctcgagcaagaggggccgggttggggccgtgcagcggccaagagcctgcttgcgaatggcatggaggcgcacgcggcgacccttaagtctatggcgtcgacaacagtcgccgcgtcggagcccagtcgatggaacttccgtgcgtcgcagcggcgggccagcacacgcgtggagccgccgcacgagtatgtggcgtcactggccgcgtcggcggtggtgctgcgcggctgcagcctgcgcaacaccacctgcatctacggcgtggtcatctacgcgggccacgacaccaagatattcatgaactccaccgaggcgccctccaagcgctcctacatcgagcgaaccgtggaccgcatcatcctcatgttcttctgcgtgctgctcatctggtgcctcatctccgccgtgtaccacgcctggtggaccaacacccacttccgccagcactggtacatgcgccccgacgccctggacgccgactccgatccggacaaccccgcacagaccggcgccgtcaacttctttgtggcgctactactctacagctacttggtgcctgtgtcgctgtacgtgtccatcgagatggtcaaggtgttccaggctatggtgctcattgcgcaggaccgcgacatataccacgcggagacggacacgcccgcgctggcgcgcacgtccaaccttaacgaggagttgggcatggtggcggcggtgatgaccgacaagaccggcacgctgacacgcaacgtgatggagtttttcaaatgctccattgcgggcgtgccgtacggagcgggcattacggagattgagcgctccaacgcgctcaggaagggccaggttctggacgaccgcgagcggcccgacgcggccaagttccgcgagcgcttcttcaacttctacgacgaccgcctgatgggcgaggcgtggtacagcgccaaggaccccgtcaccatcgaaatgttcttccgcctgctggccgtgtgccacaccgtcatccccgacggccccacggatgagaagagcatcaagtacgaggccgagtcccccgacgaggctgcgctggtggtggctgccaaggcgtttggcttcttcttcttcaagcgcaccaacaccaccatcacggttcgggagcgcacgccgcgcggcaccacggacgtggagtatgaggtgctgaacatcctggagttcaactccacccgcaagcgcatgagcgtggtggtcaaggagaaggccaacgagaagatcatcatcttctgcaagggtgcggacacggtcatctacgagcgcctggaccccaactacggccccaacgaggacgccaaacaggccacgacccgtgacatggaggactttggagcgtccggcctgcgcacgctgtgcctgtcgtacgccgaggtggaccgcgactggtacgacgcctgggccaaggagtgggacgcaggcaagaagtctctcgacgaccgcgagagcaagctggcggaagctgcggagaagatcgagcgcaacctgcggctgctgggctgcacggccatcgaggacaagctgcaggagggcgtgccggactgcatccggatgctggcgctggcgggcatccgcatctgggtgctcaccggcgacaagatggagacggccatcaacatcgggttcgcctgctcgctgctcacggaggagatgcaccagcacacggtcacggcgtcctcggcgcgggtggaggagctggaaaaggcgggccggcggcaggaggcggaggcgctggcggcggagctggtggccaagcagctggacaagattgacttggagctcaggcaggctaccgaggcggcgaccggggcagccggcaaagctggtggcgccggcgcggggccgaagcagggcggcgctggaccgggcatcggcggcggcatgggcggcgatgccattgacgcggcgctaatcatcgacggaaaggcgctgagctacgcgctgtcaaaagacctggcgccgctgctgctgcgcgtgggcctgcgctgcaaggcggtggtgtgctgccgcgtgtcgccgctgcagaaggcgcaggtgacggggctggtgcgcagcaccggcagcatcacgctggcgatcggcgacggcgcgaacgacgtcagcatgatccagcgagcacacattggtgtgggcatcagcggccaggagggcatgcaggcagtcatgtcggcggatttcgccattgcgcagttccgctacctggtgccgcttctgctggtgcacgggcaatacagctacaagcgcatcacgcgaatgatcaactttttcttctacaagaacatgctgtttgcaataacacttttcacctactcggcattcacaactttctccggctcctacatctacaacgacacgtccatgacgttgttcaatgtggcgttcacgtccgccacgccgctgctggtgggcatgttcgaccggccgctgggcaagcgggccatgctgcggtacccgcagctgtaccgccagggcattgccaaccgcgacttcaacgccgccaccatcctgggctggatgttctcggcgctgctgcagtccggcatcatcctggtgctgtgcctggtgggatgccgcggcaccaccgcctccgcagaccacggcatcccctggagcatggccgaggtgggggtggtgatgttcacgtcgatcgtgctcaccatccacctgcacctcaccatggtggaggaggcctggacctgggtacaccacctggccatctggggcagcgtggcgctgtggtacctgtacctggtggccttcgcctacttccccgtgtcgtggagcctggagatgtggcacctgttcgagggcattgtggcgcccaacgcccagttctggctctacagcctgatcatacccgcggcggcgctgctgcccaacttcgccttccgcgccgtcagccggctgctgtggccaagcgacgaggacatcatccgtgagatgcagaaggtggagcgcgcagccaacagcgactcctcgcaccgcgccggcggcgcagctggggccgcagccggcgccgccagtgagcaccacgccctgcagaagcacaagggcggcggagggctgctcatggcagcgatgggcagcggcagcaaccgcgtagcgcccgagccgcccgcatcgccgctcggtggcggcgcgcgcggcggcggcggcgccggcgtcaagtcggcggcggcgattgccgtggctgagggcgggccagggaataagtcgttcgcggtcacggcggtcattgctgctggcggcgatggggctggcgcgggcggggctggtggtgggaagggcaagggcgggcggtggagcgcgactgggcaagatggcgttgaggagctggatggcgaggaggccgcagacgacgtcacggcggcgcctccacagccgccccctggcgccctgacgggcacccggagcagccgcgacggcaaccccaacggcttcagggtggtcggcaacaaggggcctggctcgacaatgcactcagcaagtggtaatggctcccgcgccgcaagtcgagcgggcccgtcaccctttgcagcggcgctggctccgccgcctccgggcgcaaccagcaacaccagcgggctagatgagctgacgctggtctccgccgacggcggcggcatcgacggtgccgacggcggcgccgatgggagggagtcgccgctgcttggctcctttgcaccatccccgacgcgcagcgtcgccggcccgagcgtggggcatatccccatcgccggccgcagccgaaccgcgggactgcccactgtgggcagctccacgagccttgtagggggagcgggtggggtgctggcaggcaacgggcaccactcgcagcgcttcgcccaccaggctcacctaccgcatgcggcgctggcgtcgtccatctcgacacccgtgcttggggaggacggcggccgcaacaacagcgggacgggccgcgccgctgcgggcgcgggcgcgggcgtcgggccggggtcaagcgcaacggcgtcgccgcgaacgcaggccgccgttgcgcgggggcaggcagggaccatgggcagcaggggcggcggcggcggcggcgagatgcagcctacggcttccatgtcgggcgggaggatggtggttggccaggcgtccggccagacgggcgacagcgccagcggcgtgcgggaggtgtctacattgtcccgggcatcgtcgtcatcggtgcagggatag

SEQ ID NO: 173 - DNA, 4254 bp, Chlamydomonas reinhardtii
atgccgaagggctgtccctccttccgtaagaggacgggcacggaggagacgaagcgtacagtgcacataaacgcgagtcaccatgagcacctggagctgctccaccagcactataagggcaatgccacttccaccaccaaatacaacgtctggaccttcctccctaaggcgctctttgagcagtacaggcgtgttgcaaacatctacttcactatcgtggcagcgctttcgctgacacctttctcgcctgtgcgcgcgtggacgacatggacgcccctcatcatcgtgttgggcgtggctatggtcaaggaggctgccgaggactacaagcgctacaagcaggacaaggaaatcaacaaccgtgccgtggaggtgatggacccggccaccggccagtatgtcaccaagatgtggaaggacgtgcgggtgggggacctcgtcgtggtgacaaaagaccagcagttccccgcggacctgctgttcctcacctcggagacggaggaggggacgtgctacatcgaaaccatgaacctggacggcgagaccaacctcaaaatcaagaaggcccctgatgagacgaaggacctgaaccagatggacttcgcgtccttcaagaacgccaccattgagtgcgagggccccaacgcgcgcctgtaccagttcacaggcaacttgctgctggacgggaagaccctgcccatcagccccgctgccatcctgctgcgcggctgcaacctgcgcaacacggacaaggtggtgggcgccgtcatctacgcaggccacgagactaaaatctttaagaacgcggcacccgcgccctcaaagcgcagccgcgtggagcgcatcgtggacaaaatcatcttcttcatgtttggcctgctgttctcgttctgcatcattggcgcggtgtacttctccatctggacggagaagaagtcgcccaaccactggtacgtgggctcagccaacgccacgggccagtacgcgcagtacgcccccggcaacccggctttcgtgggcttcgcctccttcatcacctcgttcatcctgtacggctacctcatcccgatttcgctgtacgtgtcgatggagctggtgaagattgcgcagtccatgggctatatcaacctggaccgtgacatgtaccacgcggagacggacacgcccgcgctggcgcgcacgtccaacctgaacgaggagctgggcatggtgaacacaatcttgtcggataagaccggcacgctgacacgcaacgtgatggagtttttcaagtgctccattgcgggcgtgccgtacggggcgggcattacggagatcgaaaaggcgaatgcgctcaggaagggccaggttctggacgaccgcgagcggcccgacgcggccaagttccgcgagcgcttcttcaacttctacgacgaccgcctgatgggcgaggcgtggtacagcgccaaggaccccgtcaccatcgagatgttcttccgcctgctggccgtgtgccacaccgtcatccccgacggccccacagatgagaagagcattaagtacgaggccgagtcccccgacgaggctgcgctggtggtggctgccaaggcgtttggcttcttcttcttcaagcgcaccaacaccaccatcacggtgcgcgagcgcacgccgcgcggcaccgcggacgtggagtatgaggtgctgaacatcctggagttcaactccacccgcaagcgcatgagcgtagtggtcaaggagaaggccaatgacaagatcatcatcttctgcaagggtgcggacacggtcatctacgagcgcctggaccccaactacgcgcctaacgaggagatgaagaccacaacctcacgggacatggagaactttggtgccgcaggcctgcgcacgctgtgcctgtcgtacgccgaggtggaccgcgactggtacaccaatgtgtggatgccggagtgggtcaacgccaagacgtcgctggaggaccgcgaaaacaaggtgggcgaggtcagcgagaagatcgagcgcaacctgcggctgctgggctgcacggccatcgaggacaagctgcaggagggcgtgccggactgcatccggatgctggcgctggcgggcatccgcatctgggtgctcaccggcgacaagatggagacggccatcaacatcgggttcgcctgctcgctgctcacggaggagatgcaccagttcaccatcagcgtgtatggcgtggaggagattgagaaggcggagaaggcgggcaacaaggagctggcggaacagctgagccacgcggcggtggccaactccatcaaaacgatcgaggagaccatgacctccaagtcggagggctcgcgcttcgccataatcatcgacggcaaggcgctgagctacgcgttgtccaaggacctggcggcgggcttcctcaagatcggcctgcgctgcaaggcagttgtgtgctgccgcgtgtcgccgctgcagaaggcgcaggtgaccaagctggtgcgtgaccacggcgacaccacgctggcgattggagacggcgccaacgatgtgggaatgattcagatggcgcacatcggtgtgggcatcagcggccaggagggcatgcaggcggtcatgtcggcggatttcgccatcgcgcagttccgcttcctggtgccgctgctgctggtgcacgggcgctacagctacaagcgcatcacgcgcatggtgctgttcttcttttataagaacatgctgttcggcgtgaccatcttcgtgttcaacgccttcaacgccttctccgggcagtttatctacaacgatttctacatgacgctgttcaacgtggtgttcacagctctgacgcccgtggtaatcggcatcttcgaccgcgacgtggacaaggccatggcgctcaaataccccggcctgtacatgcagggccagcgcaacgagtacttcaacttcaaggccattgcgctgtggctgctgtcgtccatgtaccagtgctgcgtcatcatggtgttcgtgctgatcggctgcaactccaccgaggtggaccgcgacggcggcaacccctacaccatgtggcagacgggcgtgctcatgtactcgtgcgtggtcatcaccgtgcacttccaggtggtgcaggtcatcgagcagtggtcgtggccctaccacgttgccatctggctcagtcagatcgtgtggtggctgtacctgctggcgtacggcgccttcccgctgtacttcagctccgacctgtacaacctgttcgtgggcatcgtggcgccgggcccgcagtactggctgtactgcctgctgatcccctgcgcctgccagctgcccgacttcttcgcgcgcatggtcaagaagctggtgtcgccgttcgaccacaccatcgttgcggagatccagaaaaagctgcagcgcgccggccgcagcctggcggatgagaggggccaggagccgccgtccatccttgccggcatcttcagcggccaggccaacaagaaccgcggcttcgtgccgccctacgacccccgctccaagttctacgggctggtcagctctggggcgcgcaactcgggccgtatcgacacgggcgtgcgcaacccggtgctgcaacacctggaccaggagctggcggacaacccctaccgctccggtcgcaagaaggggctgccggggatatcgccaaagggatcatctgccactgccgccgcggccagcgccgcgtcggccggcaacgtccagccagtggcggctgcagctgccaatggtgccgctgacgcagcggccgcagctgctgccgctgctgcggcggcgaccacggccacggcagccgcggtcgctggagcggctccccccgctgcgccgccgccagcagtaaggtccccggcggcgcgtgtgctgccgccggttatcccgccgggcggccaccccaacggccgcgcacccggccggctgccgcccatgggcacgccgccggtggggctcactggcgcggataccatgccctcgaacaacagcgatgcgcctgccgccagcagtgtgcccatgccgccaccgccggccgtgggcttggcgcccaacccacgctccaagaataagttgccgccgctcatccacggcggcgcctcgagcccggccctggcggccacggcagcggcggcgccgggtgcgattgccagccctggcgcacctgcactggccccgcccgccacggcgaacccgcaggagcgggagatcttggcgacatacacagacgctctgcagcgttaa

SEQ ID NO: 174 - DNA, 1578 bp, Chlamydomonas reinhardtii
atggcacgtagcacgtatgatgactttatcatcaaggagaaaattggaagcggcagctatggcgtggtgttcaaggtggtgcgcaaggtggacaagcacgtctacgccatgaaggaaattgacctccagggcatgtcccgtaaggagcaagaggagtgcattcgcgagacgcgcgtgctgtcgtctctggactcggacttcatcatccggtactatgactcgtttcttgagaagggcaagctctacatcatcacggagtacgcagccaacggcaacttgcacgattacatcaaaaagcaaaagtcccggctgacggaggacctcatatggaagctgtatattcagatcctgctgggcctcaaccacatgcattcaaaaaagattctccatcgcgacattaagacgctcaacgtcttcctcgatgaggacctgaatgtcaagctgggcgacatgggtgtggcgaagattctgagcacaaacacggtgttcgcgaagaccatcgtgggcacgccatactacctgtcgcccgagctgtgcgaggacaaaccatacaatgagaagtcggacgtgtgggcgttgggagtggtgctctacgagtgctgcacgcagcggcacccgtttgacgccgacaaccagggcgcgctgatcctcaaaatcctgcgtggcaagttcccgccggtgtcggggtactcgccagacatctgcgacctcatcaagcgctgcctcacacagaacgccaaccggcgacccaacacctacaagctgctgctgcttcctagcatccggcaaaagggcgaggagctgggcatctcgctgcccgaccaggccagcctggcgctcatggcggataagaacatggcgaacgcgggcgcggcgggcaaggcggcacggcccaagacgccacaaggcgacatgaacgctccgccggaggtggcggggacatcggcgggcgacgacaaagcgtttgtgttcgggtcaacgatccgggcagacggcgcgggcgcgcggccggtggacgtgtcggtgtcggcggtggaggcgacgtcgggcgagggcgcggcgccgggtgcggcgcccgtgccggtgcaggcggcctgggcggtggacgacgcaaagcccaaagtcaaccgcccaccagcatggggcttggcgcagcagatggaggagctggcggtggatgacggggaggacgaggacgagggcaagaacccctacctgggtgtgggcggcgacgacgacgaggacgatgacggagagggcgatgacgacgacgactacgacgacaacggggagtacggcgacgagccgggcgagggcgagccgggctggtccgccgaccccacgcgcatcgcgcacatgaagagcgccatgatgatccagcgcgcggcgtgcctggacctggtgggcgagaaggccttcaacgagctgtatgcgctgctgaagagcaaccaggtggatgaggcgtccatgacggacctgtcgcgcctggtgttcaagatcatcccgtacgacaagtccgaggtcatccagatgatgtacaagctgctgtacctggagtcgcagctggaggggcagtga

SEQ ID NO: 175 - DNA, 1224 bp, Chlamydomonas reinhardtii
atgctgctcgcggcgcaatcaatgccaaagtgcatatgggataacgttaccggcgcgttcggccagtgtgtcgcgaacgactacacgctgctgtccatgagcggaaaaccaccgactgaatccgccaggctgttggcgtacgcccagcaccgcgcagtgctgtgcaagcggctcacgagcgaggcggcgtgcctcctagccatggacctggggtgtggctgggaccggctggccggcctatgcttcgcctcggacgcggcgctgctcagacccgaggtgctgcaagggcggctcttctgcggcggctccctactcgaccaggcgacccgctgcctgctactgccggggcccagcaacggcagcagtggcagtagcagcggtggcgggggcggcagtagcggcaccggctcggtcgcggcaaccagctgtagcgccgctcacaccgcttgcacctacctcagcccaacgcagctggcggcggcgttggcggcaccggcggcggcgacggcggctccatacctgcggctggcggcgctcgccaatttcaacgactggccgcctccagagggcagtggcgcatgtgtggccaaatggttgacgcaacccgacacactggcagctctggcgcgcagcgtctccgccaacccaacggtctggttgctgcagccagacctggtgggctcgggctgtagcagcacgctggcaggagcaaacatcagcgcagcacccgagatggcgcgggtgacggcggcagtagcagcggcggcgtccgcgtgtcaggcagcgggcgtcgccggcggcgcggacggctgctcggcggcggaggatggctgcgactgggctgatagcggaggggcaaccggcggcagcagcacaagtagcggtgatagcagtagcggcggcgggacgtgcagcgtgggcacggcggcgcttctggatgcgttgtttgatccacaagacgcctgggtgagggcgcttgatggcacgaccgccctctgctccgcccagggcactaccgccagctgcgccgccgccggatccattatcgtggatccagcccggctcgacacgtggcgggacgtgctggtagacggcggcggagattgggtggacggtggcagcggcggcgcaggcggcctggcggcggggcaggcgctgccgctgctgcgctggatgctggtcgtgtgggtggtggtgtttgccggcatggccgccgtgtattaa

SEQ ID NO: 176 - DNA, 693 bp, Chlamydomonas reinhardtii
atggtcgctggagggttgcagcccccaagcattgacgaggaggaggctgcggcgcgcgctgtgggccagggcgttatttttatcctcgatgatgctcagttagaggttgcgcaagtcggcaagacctaccagctgctgaactgtgatgaccacgcgacatatcttcgaaagcacaaaaaggacccggcgctgtaccgcccagacatttgccaccaggcgcttctaaacgtgctcgacagcccgctcaacaaggccgggaaaatcaaggctgtgtacgtgcgcacgcacaagaacgtgctgttctccatcaaccccaagacgcgcatcccgcgcaccatcaagcgcttctccggcctcatggtgcagctgctgcagaagctgtccatccgcgccaccaacggccctgacaagctgatgaaggtgattaaaggcccggtgactaagcaccttccgctcaactgcaagcgcgtgggcttttcattcgccgcagataagcacgtggccatccatgagtacgtggcggggctggaggacagcgggcccattgtgttcgtggtgggcgccttcgcgcacggcaagatcgaggcgccctgggtggatgaggagctaaacatcagcgagtacccgctgtcggcggcctactgcctggcgcgcatcacgcaggcgttcgagatgaagtggaagatcgtgtaa

SEQ ID NO: 177 - DNA, 1170 bp, Chlamydomonas reinhardtii
atggcggaccctggggcccaacctgtcccagctccccagtctgcggaagagccggtcaccggaggccttcaagagtccgtggaagtcacagcgtcagggaaattagactcatacaaccgcgagtacaaccaattcctggtttgcggcagcctctttgagtgccccgctaagtacctgcccatcaagcccatcggcaagggggcgtatggcgtcgtctgctccgccaagaacctggacaaccaggagaaggtggccatcaagaagatcgcaaacgcctttgacaacgtcatcgacgccaaacgcaccctgcgcgagatcaagttgttgcgccacctgcagcacgagaacattgtgcagatcaaagacatcatcccgcccaccaaccgcgatgccttcaaggacctctacgtggtgtatgagctgatggacaccgacctgcaccagatcatccgctcgccacaggcgctgtccaacgaccacagccagtacttcctgtaccagctgttgagagggctcaaatacatccacagcgccaacatcctgcacagagatttgaagcccagcaacctgctcgtgaacgccaactgcgacctcaaaatctgcgacttcggccttgcacggaccagcaccagcaacgagaaggagttcatgacggagtacgtggtgacgcgctggtaccgcgcccccgagctgctgctgagctgcagcggctacaccactgccatcgacgtgtggtccgtgggctgcatcttcgcggagctgctgggccgcaagccgctgttccccggcaaggactacgtgcaccagctgtccctcatcaccaaggtgatcggctcccccagcgaggaggagcttggcttcatcaccagcgagaaggccaagcgctacatccgctcgctgccgcgatccgagcgagtggacttcgggcagctgtggccgcacgtcaccaagacggcgctggacctgattgacaagatgctggtgttcgaccccaccaagcgcatcaccgtggagcaggcgctggagcacccctacctggcctcgctgcacgacgtgtccgacgagcccgtgtgccccacacccttcaccttcgacttcgacagcgagcacctcacgccggacgtggtgcgggaggtcatactgcaggacatggccgagctgcacacctga

SEQ ID NO: 178 - DNA, 1872 bp, Chlamydomonas reinhardtii
atgctgcagagcctgctgatcgtgctgctggggtgggcgcgcgaggagcacgtgcccctgcgggcgggtgcgctggcggctgcagaggctgcgctggcgctgccggacatgggcatgcccagcatacccggccgggccatctttgctttcctcaaggcagtggaggtgccggtgctggtgctgtgcgacgagatgcagcggctgttcctgccgctcatcggcggcgccgagccggacgctgccggggccgcgtacatgcgcgacgtgttcatgaagcagctgctgttggacggcccccacaccatgctgtggtgcctcacgggatcatccatggcgcacacctgcatcagcatcgcgcgcatgccccccaacggctacccgctcatcaccatggcctgcgccatccacctgccagcgacctacagcgccgcgcacgtaagcttcgcgtggcagcagctgcagcagaacagcggtcctgatgtggagctggaccgccagctgctggagctctgcccgcagtcaatcccgctcctgacgttcttggtgcacacatggttgtacaaccgcggccgcagcgacgtgcacaccttcgtgcgcgacttcatgcggttcaagctcatggagcaggcacgcagggagtggacgcctggcctggaggccgtgccggcgtcgcagcggctcacgatcctggacctgtcgtttccggccgtgggggcgcgcatcgacacagggctgcaccccggcttgaagtactacctgacgccgcacctggagaagagggcggacggccactacttccttcgcgactcgcaccagcgtcagatcgtgcggttcctgatcaacgaagaaggcgcgctgcggagcggattgggcgagctggcgttcagcgcgaccctgacgcagctggatggagggtggaacctgtttcacctgggggaggccgcggactacctgctcggtcccggcgcatgccgcaggtggcagaacggggagccgccggctgagacggacgcgttcgaggacaagttacaggccattgccgacgacgtcgccgtgaagctgtgcgcggcaggagcggcggcggcaggaggcgatcagcagccgcagcagcaacagcagcagcagcagcagcagcagcagcagcaccaggagcaaacgcagcagcagcagcagcagcagccgggcagcggcggcggcggcgcggcgctgggcccccagccgggcccccagccgcaggagctgtgggagcggcagtcctggttccaggaggcgctgaactcggagtggaacagccgtgatcgcgaggcgtacatggaggaggaggacaacaagcaggcgcggcgcacgcacctggccatgctggtcttctacctgcggctgagtcgcaacgtgcttggccgtacgaagccttgggatcgggagactggctccaagctgctggatgtgggggtggttgaggcgctgcccggcgtgctgggccagtccctctttgccttcaacgaggcaatggtgggggcgctgcggctgctgccgcgccccaccgtgcaagccgccgctgcggcgtttgcggcggagctgtcaggcggcgtttgcggcggcagcgttgatgagggctcgggcgaggacgacagcagcagcggcggtggcctgagcagcggcagcggcggcgccggcagcaccagcggcggcggagggcgggggcgcggcgcaggggcgatgcctatccaatgcgcgccttcgcgcccggcgggaccagcggcggcggcaggatgtggtcagcgcccgccgctggtgtacgccaccggcggcagtcgcggggggacggccatccgcggccccccctcaaggcccaccacacgccacgtgtgttag

SEQ ID NO: 179 - DNA, 762 bp, Chlamydomonas reinhardtii
atgctgcttttaggactcgttctggccctcgctggccatgtagcggctgcgccttcaagcgccatgatgggcactggccacaccgtgggctttggcgagctcaaggaagaatggcgtggtgaggttgtccacctgtcgtggtcgccgcgagccttcctgctgaagaatttcctttcggatgaggagtgcgactacatcgtcgagaaggctcgcccgaagatggtcaagtcttctgtggttgataacgagtcgggcaagagtgtggacagcgagatccgcaccagcaccggcacctggtttgctaagggcgaggactctgtcatctccaaaatagagaagcgcgtggcgcaggtgacgatgattcccctggagaaccatgaggggctgcaggttctgcactaccatgacggtcagaagtatgagccacactatgactacttccacgaccccgtcaacgccggccccgagcacggcggccagcgcgtggtcacgatgctcatgtacctgaccacggtggaggagggcggcgagacggtgctgcccaacgcggagcagaaggtgaccggcgacggctggtcggagtgcgccaagcgcggactggccgtgaagcccatcaagggcgatgcgctcatgttctactcgctgaagccggacggcagcaatgaccccgccagcctgcacggcagctgccccacgcttaagggtgacaagtggagcgccaccaagtggatccacgtggcccccatcggagggcgtcattga

SEQ ID NO: 180 - DNA, 1803 bp, Chlamydomonas reinhardtii
atgggcgcgaaccagagcactgaggaggtgctggacgccgtgaaccaggcggacgtcgataagcttgcgccgacgcctggccctagcaaggagggaggcgccaccaagctctacaagtacatcgtcacacccagcggcgagggcaactgggagctggcgagcgcaaacgccaagccacgtttctatgacgcgctggaagactcgaacgccagcggcaagaaggatttcttcctggagattgagcagggcgacgtcgacgtgcacgtagatgcggagctcaactacgttcttgacgtgaagcagcgccgcatcacctttcacgccaacggcaccatctacgcgctgcgcttcccgcacgacacggcctgccgcgccttcggcgagcagctcaacgacgcgctgttctacaaccagtacggagtggagaacgacgacgacagccgcgccaagctgtttgaggacaacgccggcacactgttcagcaagaacacggatcgcatgtttgagcccatggagacggacgacgcgggcgacgaggcgggcgcggaggcggccacgccggagacgatgacggagcgtcgcgccaaagacacggagaaggatgaggacgccatcaacggcatcatcatgggcgcaggcgagaacaatttcctcatgcggggccgccgctttgacgtgcttcgcaacctggagggcggcggcgtggaggacaagggcgtcagcttcagcctcacgcctctggccggcggcgccgccacgccctcgctcagcacgcgcaagacccgcggcacggcggcggcggcagaggccgacgcgctcggggcgggcttcacgccctccaaggtgctcctgacgcacggcgagcggcgcatgaacctgctgacgcccgacaaccggcatgtgctccaccacgccgacattgaggcgggcaagatcgtgagcacctttgctttccagaaggacaccgtggacatccccattgtggagatcgcgtcggactacaaggccgcgcagatggaggagcactcgcagttcctgggactggaccagaaccgcctgtgcaggtgggacatccgcgaccggcgcggtgtggtgcaggagatgcccactgcgctggactacgtgggcggcaaagactacagccgcggcaccaacttcacgtgcatggccaccagcggcgacggcttcgtggcggtgggcgccaaggacggccgcatccgcctctacaacagcaagacgctcacgcaggcacgtaccgtatgcgagagagtatggctgggagtggccaagacctccattcccggcctgggcgcgcccatcaccgccgtggacgtcacgtacgacggcaagtgggtgctggccaccaccgaccactacctgatgctggtcaagaccacctacgtggacgacaagggccgcaactccaacggcttcgagagccgcatgggcggccgcggcgcggtgccgcggctgctgcggctcaagcccgaggacggcctccgcacgaagggcgccaagttcagcaagggcaagttcacctggatcacggagggcggccagtcggagcgctgggtggtggccagctgcggccgcttcagcgtcacttggaacttcgccaagatccggacctccaccaccgagtccattggctacggcggcctgcccaccagcatggactacgtgctgcgctccaaagaggaggaggtggtggacgtggcgttcgtgcaccagaagtacatgcgcgacgtggagcaggcggccatggtggtggccacgccgcacagcctgttcaatctggcgtaa

SEQ ID NO: 181 - DNA, 1041 bp, Chlamydomonas reinhardtii
atgagcatcatttacgcactcacgctggccctcaacggcgcgggccccaagacgtccacgcactcggagctgctggcagccattgccggcggcgccgagaacgccgccaacttgggtgagggcgacctgaactcggagctgggccgcaccatgacgctgctgaacggagccggcgccggcgcggccgagggctccgcctcccgcatggtgctcgccaacagcgtgtggacgcaccgcggcaccacgctgcgtaaggagtacgtggacgccatgcagtcgctgttcgacgccactgcgcgcgaggcggtgaacggcgccaaggacgtgaacgcctgggtggagggcgtgaccaagggcatgatcaaggacctggtacaaaccgaccagtgggacgccatcctggccaacgccatttacttcaaggggttctggacgcacgccttcaagaaggaggacacctttcctggcgagttcaccacgggcgccaaggccaccaaggaggttcccttcatgtgcaagaacttcgaggcgcaggaccgcattaccgccgtgcgcaaggagggtctgtacgacgcagtggcgctgccgtacaagggcgacgccttcagcgccatcgcgctgctgccggcggtgggcgtggccatggaggcggcgctcaaggactggggctcggggccgcaggagctgcgcccggtgggcaagtgctttgtcaagctgcccaagttcaaggtagagagccagctcagccttaagaccgtgctgcacaagctcggcgtcaagcaggcattcggaggtagcgccgacttcagccgcctcagcgacaccaagatgtttgtcagcgacgtcgttcacaaggccgtggtggaggtggacgaggagggcacggtggcggccgccgccaccgccgtcatgatgctgcgctgtgcgctgccgatgcccacgcccgagttcattttcaaccgccccttcgccttcatcatcatgcacacccccaccggcctgcccgcgttcgtgggcaccgtgaacgaccccagccagtga

SEQ ID NO: 182 - DNA, 1818 bp, Chlamydomonas reinhardtii
atgaggctcctagttgcctgtgctctattggcactactgcagctcagcgctgcagtgcgcctgcccgcggcgatagagcaggctgtggggaggcagctcctgagcgagaaggaccatagctaccagcctgatgacaaggtgccgctgtgggctagcaaggttggacccttcaccaaccccagcgagacatacgagtattacagccttccttactgccagcctaaggatggcgtgaagcacaagctgctgggcatgggcgaggtggtcgacgcaaaccgcatggccagcaccccctaccagctgcagttccgcaagaaccgccagcgcgaggcggtctgcgagcagcttctggatcaggagaagcttgcaaaattccgcaaggcggtcgaggaggactggtactttcaaatgtactatgacgacctgcctgtgtggggtttcatcggcaagatggagaagctgttcaagccgggcggtgttaccgagtacaagtattacctcttcactcacatcgactttgacatcaagtacaacgacgacagcgtgattgagattaatgtctccacagacccccaggaggccgtggatatctcggaggagattacggacatcgtgaaggcgaagttcacgtactcggtgaagtggacccccacgctaaccaagtttgagcaccgcctggatcgctacgagcgctttcccctcaaccccgtgcacctggagattcactggttctccatcatcaactcgtgcgttaccgtgctgctgctgacgggtttcctggcgactatcctgatgcgcgtgctgaaggcggacttcattaagtacaacaaggacgatccggccatggaagaggaggagtcgggctggaagtacgtgcacggcgacgtgttccgcttccctccctacaagaacctgttctgtgcctttgttggcacgggcacccagctcttctatctggcgctgtttgtgttcgtgctggcgctggtgggcgtgttctacccgtacaaccgcggcgctctgtactcggccctcattgcgctttacgcgctcacggccggtattgccggcttcgtggcgtcgtcctactacaagcaaatggagggcgagctgtgggttcgcaacatcctgctcacttgcttcgtgtactgcggccccttcctgctcatgttctccttcctgaacaccgtggccatcgtgtaccggtccaccgcggcgctgcctttcggcaccatcgtcatcatgatcctcatctggactctggtgaccatcccgctgaccgtgttcggtggcattgccggcaagaacaaccgcgctgagttcttcgcgccctgccgcaccaacaagtacccccgcgagatcccgcagctgccctggtaccgcaccacggtgccgcagatggtcatggccggcttcctgcccttctccgccatctacgtggagctctactacatcttcgccagcgtgtggggccacaaggtgtacatcatctggtccatcctggccattgtgtacatcatcctcatcgtcgtcactgccttcatcaccattgcgctgacctacttccagctggcggtggaggaccaccagtggtggtggcgctcgttcctgtgcggcggctccacgggcatcttcgtgtacggctactgcttctactactactacgcccgctcggacatgagcggcttcatgcagacgacgttcttctttggctatatggccatggtctgcttcggcttcttcctgatgctgggcactgtgggctggcgcgcgtcgctgatgttcgtgcgccacatctaccgcgccatcaagtgcgagtaa

SEQ ID NO: 183 - DNA, 417 bp, Chlamydomonas reinhardtii
atggaggttatcaccgctgtcaaagcagtcaaagctgctgctgcctctcgcggcgtgaagggcgtggagttagggcagctcatggcctgcctggcctcgatacctgctgaggagtaccgcgccttcattcttccaatagccgatgaccccgaggcggtctttgcgtacgtgcaactccgttacaaggctcaagcggcgccggctgtcggagctcgcgcgcccactgcgcagcagccgtacgccgacatggcgatgctgaaggacgcgctggcggagcagatgcggccgctgatgtccaaattgcaggaggtgctggctgacaacgcggcgcggcatcaccaccccaactgggccgacgttcgacgggagtgggctatgagcacggcggcagtgcccaagcagaagaaggtgttgtga

SEQ ID NO: 184 - DNA, 2187 bp, Chlamydomonas reinhardtii
atgggctgtgtcggttcgaaggaggatgctgcggatgttgcaaaggcccctcccagggccgaagccggtaatggcaatggacatgtagatgctgtaaaagctcaagcagccgcggcacagccggcccctgctgccgcgccagccccagccctgctggtcgaagcccctccaccggccccgcctgcagctcaagccgctcccgcagtgccaacgccccaacccttgtacaacgggccagatcaagggttgcctgcaccgcggcaagcacctccaccggccccgcaaggtgctgcgcctcctcctcatcatggaccaccaaggcgggagcgttcagagttaaagaagcggcaggggacggaatatgaggaggattcggactgggaccagtgctccacagcaaacttcaacgttgacgaggatgcgcaggccaaagattgcgaggtgccagcggtcggggcaagcgtcatggagaaggcgctgcacaattcgctatttgctcaggagaagcacgtgcccgggccggacaacgtgtacaaggagacgacgacgctgcgcatagacaaagtgaaagggtgcatgtttgtgaaccagtacctggtggtccgtttccttggtcgcggcgcgtgcggcaaggtgttcctgtgcctgaacacgtacgacctgcggctgtacgcgatgaaggcggtgcgcaaggtggacctggagagctcgcagccgccgcagcagggcgccaaaaagcgcaaccccatggaggacctgaagcgcgaaatcatgatcatgaagaagatgaagcacaccaacatcgtgacgctgagcgaggtgattgacgaccccgccggctccaagctgctgctggtgatggagtacatggagggcgggccggtgctgacgcgcgaggcgctggagaagcgggagcggctgccggagagcctggcgctgcagtacttccgggacatgatcaaggctctggactacctacacggcaacaaggtggtgcacggcgacctgaagccggagaacgtgctcatggccgccagcggggaggtgaagttgtccgacttcggctgctccaaggtgttcgccaccggcaacgagtacctggagcgctgcaacggcacacccgccttcctggcaccggagatgatgaagcccaacacgcgctaccgcggccggcccacggacgtgtacgcgctgggcgcctgcctgtacacgctgctgttcgggcggatccccttctccgcgcccaacctgtacaagctgttccaggtggtgcagaacgagccggtcaagtacccgccggacgtgcccatcaccgaggagctgaaggacctgctggcgcgcatgctcaccaagaaccctcgcgagcgcatcggcatgtcggagctgatgcgccacccctggctcaccatgaacaaccgcttcccgctcaagccctaccgcgagctgcgcgagggcgagagccaggagatgcacaacggcgtgatgggcggcctgacgtttgcggaggccaaccccaagcccgacttcctcacgggcctggccaacgtgagccgccacgagcgcgtgttccaggagggcgacatcatcatgcgccagggagaccagggcacctacctgttgtacgtggtcagcggcaccgtggacatcctggtcaagtgggtcaccatgccgcgccgcaccaacagcgcgcaggtggcgcaggggcagcagggcgtgccgggcgccaagcccgccgccaagccgggcgcgggcgtggacgagatgatggaggacagcgacaccatgtcgcccattgtggacgaggagagccgccagcaccgcgtcaacctcatgcgcgccagccagaaggcgggagagttcgtgcgctcgctgcaggccaatgcgggcaccacgcgagacctgctcattgcccagcgcggccccggcgagctggtgggcgagatggcgctgttcagcaagagcctgctgcgcaccgccaccgtccgctgcgccaccaaggtggtcacgcgcgtcatcacgcacgagcagctggtggagtacgtgatggccaacccgctggccaagcaccaggtgcgcgaggtgatcctgaagaaggagagcgagatcactatggtggaggcgctggtgaagctcaccaacgtgcaggacgtgatcacggcctcgctggagcaggcgccgcagttttaa

SEQ ID NO: 185 - DNA, 600 bp, Chlamydomonas reinhardtii
atgggtggcgagaagctgcttgaccagatcttcaacctaaagttcaccgccaagcagcttgcacgctcggcagtgaaatgcgagaaagaggagaaggcagagaagttgaaggtgaagaaggccatcgagaagggcaacatggagggcgccaagatctacgcccagaacgccatccgcaagaagaacgagcagctcaactacatgaagctggccagccggctggacgccacagtcagcaggctggagacgcaggccaagatgcagatggtccagaagaacatggcgggtatagtcaagagcctggagaaggccatggcctcaaacaacctggagaccatcgcaaacaccatgacgcagtttgagaagcagtttgagaacctggacctgcagacgcaggtggtggacgacgtgatgggcgcgcaggcctcgctgtccacacccgaggacgaggtgtcggcgctggtggcgcaggtggctgaggagcacggcctggagctggcggtgggcatgccccacgccgccgccggcaccgcccgccccgccgccgccaaggccgaggacgacctcaccgcgcgcctggcggagctgcgcggccggtag

SEQ ID NO: 186 - DNA, 903 bp, Chlamydomonas reinhardtii
atgccgggcgagggagcagctggtgcagcgggcgggggctctgggcgtgcagcagaagtccggctctacgtcgatttcatgagtcagccctctcggtgtgtcgttatcttcagcagggtaaacggcctgccagtggaggtccgacccatcttcatacacaagggcgagacacgctcccctgcctacttggcgctgaacccgctgggcaaggtgccgctgctggaagacacggccgcagctgcctccagctcctccgggcccggacccggacccgccgcagccgcgggcggagctggcggcagctgcgtcctgcgcctgcccgagagcgccgccatcatgagctacctcgctgacaggttcccgggccgtgtggcggagcactggttcccgcggtcggacctggcgcaccgggcccgggtggaggcggcgctgcactggtaccagggcaatattcgtgccggcgccgccaagctgtcattccacaaggtgattgccaagcggctgggtgtgcccagtgacgagcgagtggcgttggacgcactcaagacactgcagctggccctgtcggcgcttcaagacgtgtggttgggcggcggtgtcaggcgcttcatgaccggcgagctgccgtgcgcggccgacctgctggcgtgctgcgagctggagcagctgcgcatgctgcgtgcggttgagcacggcacggacatggaggccctgatggcgccctacccgcaggtgcttgcgtggcagcagcgcgtgcgcgatgccacctcgccgcactacgcccaagtgcaccgcgtgctcatggcggcggtggcgcagaaggcggcgccggcggggtcgggggcggtggcgggggcgggggcgggtggggcgggcggcggcgcggcgcagagcaagctgtga

SEQ ID NO: 187 - DNA, 2328 bp, Chlamydomonas reinhardtii
atgtcggcatttgaggagctgggcgtcatgccggagctggcaaaggcggtagaggacctggggtggatgctgccctcgccggttcaggccgaggccattcccctcatcctgggcggcggcgacgtcatggcggcggcggagaccggcagcggcaagacaggcgccttcgccattcccatgctccaaatcgtgcacgagactctgcgccagcgtgcgcgcagcggctccgccgccagcaccagcggccgcggcgcagccggggccgcagccgcagccgccagccccgcagccgtgccgtgtgtgctgagtagcgaggaccgggagctgcacgtggcggtgtcgccggacgggctgtcggcacagagccgctcggagaaggcgtggggcggcgtgcgcggcagcgtgggtgtgttcgccagctgcggcggcaaggtgtactatgaggtgacggtgactgacgaggggttgtgtcgagtgggctggagctgccccaccgctgcgttggagctggggacagacaggctgggctggggctttggcggcaccggcaagaagagccacaaccgccagttcgacagctacggcgagccgttcgccctgaacgacgtggtgggctgcctgctggactgcggcgaggccggcggcagtgtggccttcaccaagaacggccggccgctgggcgaggcgttcaagctgccagacaacctgcgcaaccaggttctgcaccccgccataacgctcaagaacgccgaggtcgcgctcaactttggcgccacgccgcttgccttcccgccgccgcccggctacatcccgctcgctcaggcgccagccgcctgggtggcggcgggtggcggcgcagccgccgccagcgcaggtggcggcggaaacggccgcggtgagaaggaccttgggcgcaagcctgtgtgccttatcttggagcctgccaaggacttggcggagcagacagccaactgcttcaacgactacggcaaacacctgaaggcgccggaagtgaagacggggctgttcgtgggcggcatggatgcagcgccgcagattcggatgctgcgtgagggagtggatgttgtggtgggcacacccggccgcgtgatcgacttcgtggagagcggcaagatccctctagaccagatccgctttttcgtgctggacgaggcggaccggctcatcgcggacaacccggacgtgatcaccaagctctacggccgcctgcccaagcagggcaccggcattcacaggctgcaggtgctcctgttcagcgccacgctgcactcgcccgaggtgaaggacatggctggccgcatctgcatcaaccccatcctggtcgacctcaagggccgcgacgcagtgccggagaccgtcgaccatgtgctggtgcgggtggatccgcgcgaggacaggagctggctgcagagcaatcccgaggtgttcacggacagctgccacgcactggaccgggtgggccccaacgccgcggccagccccgagtgcctgagcgagggcgtcaagcgcctcaagcagcgcctgctgcagcgcatcatagacaccatgaagatggagcagtgcctgatcttctgccgcaccaaccacgactgcgaccagctcgagcgcttcctcaacacgctgggcggggcaggcggcggggcaggcggccgcggcttccgtggcaagcgcgagagcggcaaggagaacccctacagctgctgcgtgctggcgggcgcacgcagcatggacgagcggcgcgccgcgctgtccgcgttcaaggacggggacgtgcgcttcctcatcgccactgacgtggccgcgcgcggcattgacatccgcgagctgccctacgtcatcaacatgaccctgcccgacaaaagcgaggactacatacacaggattgggcgcgtgggccgcgccgacaccatgggtctggccatcagcctggtggccgaggtgccggagaaggtgtggttctgcaccgtcaagggcatgaaaccctggctggcgcccgacagcagcaacacgcgcaccacggacaagggcgggcacacaatctggtacaacgagcgcgagttgctgggcgccattgaggggcggctgggccggcccatcccgcccatgtcggacgacctcacgctgccgccggagctggcggagcggctcagcgcggcgggggacaagtacggccagcagcgcggtggcggagtcagcaaggaggtgacggagcacctggcggcgatagcgtccaacgtggcgcagctggctgggctggagtggcaggtgcaaaccagctacctcagcctcaaacggaaatggggctag

SEQ ID NO: 188 - DNA, 780 bp, Chlamydomonas reinhardtii
atgctctcctgcagtgctctgtctcgcgcgggccttccacgcgcttcacggcaacccctcgttcgccgctctgacctgctgctggcaaggcagaacgaggcatggatatctgggcaaggccttggatggtgcagtcgcgttcgcgccgtcgagacactcgctgcaggcccagccggcgaggcgatcgccgagcttatttgggagcttccggcaggcttggccaagcgtgttttcattgctttttgggatatcaaggagcagctggcggccaagtccgaccaactggcggccaagtccgaccagctggcgacaaaaactgaggagctgtacaagatcaaggtggagctcacgcgcgcgctccacgctgcaggcgtcgtgaacgcccgcacgttcctggagtacgtggtgaagcagtgggagcacgagctgttcggctctgtggggaaggtgaaccgcctgaaggtcatcaaggcggggctccgcaagcgcccggagctggtgaagtgcctgcagcggaacgtgcccacctgggtgcgcgccggcatggacgaggagcggatcgtggaaaatatggccaagaacctggaggccatcatgctggactccagcaacaatgtgcacacgttccaccccgcgattgggctgactctgctcaaggcggcgcacagcgagcccatggtggctgcgctggtgtgcgttgcagacaacatgggagtgctggtcaaagtcattaaaatgaacgcgatgaacgacaacaatgacaacaacatctctgcgtga

SEQ ID NO: 189 - DNA, 2865 bp, Chlamydomonas reinhardtii
atgacgttggacctgctccttgcagacattgccgacggttcaatcttgacctcggggggcgacagcctggtctgctttgagaaaaccggtcagcggcgctggctgttccggttcaaccgcaagaccgaggtagtggccgacaatcagaccttcacctactcggcacgccaggatggtgccagcccctttatcgcggtatcgagcaccggccttgtttacctggccgccgccgacgcagttctgtatgcgctggacgtgcgcaccggcgacctcgtgtggcactggcgcgacagcccctccacatttgagtccatcacgtacggcgacggccgtgtctacgtgtccacaactgatttcaagacatatgccctggacgtggtaacaggggaggttttgtgggggacgcagttccggcgtgtgtcctcctggaccaccggctggttcaagggcgtgtttgtgcgcccagacgtggacgggcgcgtgtggggcgtggatgctgaaacgggcgacctcatttggatgttcaacatgggtgctgagattcaataccggtgggacccggaactgcacttccatccctcgggcattggattcatgatggctcggccctcccagatctgggcatacaacgtgacttcgggtgacgtcctttggaagatgaatgcccgtgagggatacatgagccctgacaatgatggcgacaatcggcagacgttcgaggtgtggggagacctggtgatcgctcaagatgagggcgccgttgaaaccaaccccaacaagtacggcatccttcaggctctggacgtgttcactggcgtgcgtgtgtggatccgcgacgacgtctacccgggcaagtacggcatggtggtcaccgaggggctgctggtctacaccacctacataccggatatgtctaccctggacgtgtcttcttcgctcctgatcagcgccatgggacccgaccaccaagacgtctggaactggcagcgcgatggcgcgatacccgccggccagatccaggcgctggacgggctcgtgttcgcgctgcaaggcgagatcgccaacaccaccttcaatggcttgggctcgtccacggtgctggtggcgctgcctgccacgcccagcgtcatttgcccgcccgatgtcaagtccccgccaatcactgtgaacaacaaccagcaagggaccaacgctgtaatagctccgccgccgccgccgttcgtgagcggcaagcccttctgctggactcattcattctcctacaagcctctgggcagccctacctctgacggcgtgcgggcgtacggccaggacaacgcggggttggtcattgcagtgtacctggacacgggggctattgcctggaaggccacttgcgggcccgatagcaattcgttatactacccatccaacgtggttgtggtggacggggtggtttacctgggctgctccaatctggacgtgcaagcgcgggacgcggccaccggacacttgctgtggcggcgcccatttcagctgacgcccgaccgtgcggcgtacaggggcgggatcatagggaaccccgccgtggcgaacggcaagatagtcataagtaaacccgacggctttctccaagcgctcaacatcacgaacggtgtcgaggtgtttgccaaaccactggagcccaagtgggccatggaacccgggcgtctcaacttccgacacgacaacaccctggtctacgccacctggtggccggacgcgcagcttcaggccaccacgatcggccgcgacggtggagaccttgcatggaactaccccatctcggacagcaccggggtctactcggtgctggtcgtgtcgggtgaggacctgggcctgccccatgacgcgctcttctacaacgacaacgagggcctcgtcaccgccctggctctgggcagcgatgggcctacagaagtcatgtggacggtggacttgaccgacgcgaggttgtggcccggggtggagaacctgctcacacctggccagtccgactgggcgcagattacctactctaaccagacgctgtacgtccccacgacccagggaatgtttgttgtcggggccacaaacggtgaggctctgtggtccgacctgcgctcccgcctcaacgccaacattcacgtgatcgagcggccgggcgggccccaagtcatctatggcaggtacctgtctaactttgagtccaacacgcctcagtgccggccccccaagccatccggccttgtcacaaagatctctgtgcgcggttccgtgcccgctgatggcggcgaggagccctcaacgcccacagacgcgccagcgcctgacagtcgcccggtgcctgtgactgcctccccacctccatcggttactcccgcccccgccccttccccgtcgccctctcctccaccatctccctccccggcgcccgtgcgctcgccgtctcgctcctcctcgcctccgccaccaccagtgtgcccgccctgcccagccattaactgctccgcgcccgccaagaggccctcgtcgcccgccgcggtcgcagtggcactgggtctgtctggcctgccgtacaacattgtgaaagccgactccaagctccgtgaccgggttgcgggggctgtggagaagctggtcagcggcaaggtgactgggttcgtgcgtgtgcgagtgctgggtgtggagagcaccgcgggcggcacggcggctgtgctgcgcctgagcctgcagcgcagcggcggtgcgtctgctaccgctgtggcgtctgcgattgaggacgcggctctgaatggcaagctacaggaggtggtgcttgcggccaaggtgccggccaaggtgcgcagcgtggtgctgaaggtgtga

SEQ ID NO: 190 - DNA, 612 bp, Chlamydomonas reinhardtii
atggcgctgggaggtgtgctgtataggcaagctgccactggctccggctcaggattcaaagtgcatggccaggctgtctccctgaactcccccggcacatctccgctactgccgctgctagtgctcggcagcacgggccttgtccaggtgtcggcggcctggacggggctgggggcctgccactggcacctgccctggctgctcaatgtccagctggggctcctggcgctactactggccagccagatgtgcatcacggccgcagtggtgtcggcgtctgaagccaaagccggtattggccgggtggcggggctgccacacgcgccatccagtggacgggaggtcttgtttgacgcgctgaggtcgcactggggccccggcattgcggtcgtggcagtggaagtgacaacattgctcgtcgcgtgtttgctacacgccatgtacatacgggcagacgaagccgcggaagaagcggaagagctaggagccacccgccagggagatgcatcagcgccgttgcttactcctaggcgcaatgaacatatggcgaccagcggacaacggacgggcatcgcatcacagcctacccgacatgcgagccaacgggtgtga

SEQ ID NO: 191 - DNA, 603 bp, Chlamydomonas reinhardtii
atggccgacagctcggcgcccagctccttcacaattctagcaacggggcaactcgagtgcgctgagatccccgagtgcaccaacgcgtacctgaagttccaatttgttgccggcgaggactggcaattactggatgggctagaggagggcatcacgcaggccgcacgtgtgccagaaggtcgcgacggcgtactggtctggaacttccccatcgacatcacatacaagaccacgaacgcgttcgggtggccgcagctggtggtggcggtgtatggcctggactcgttcgggcgtgacgtcatcaagggctacggatgcatacacctacccatggcggccggccggtacacgctcaagctgcggctgttccggccgcgctcggcgtcacttctgcagtcgttcacgtcgtggctcacgggcatgcccgccgagttctccgaccccaagttccccagctacggcgagggccgggaagtcacgcgtgtgcagtcaggtggccacgtcaaggtgcaactcaacctcatgaccaaggacatggacatgttcggctacgtggacggcagcgggagagaccccgccgtgagcgccatcacgcaaatgtga

SEQ ID NO: 192 - DNA, 6294 bp, Chlamydomonas reinhardtii
atgaatatcagttgctactcgtccattgtcaaggagtcagcgcgctctctggggctggggctggggctggggctgcccggcgccccggcccagcagcagcaccaccaccccagtggcgttcccggcagcggtgcgcacggcgctcccagcctgctgcccacctccgtggtggactcggccgcctgcgccgtgacggtcgtgtcctggtgcagcgctagcggccgctcagccatcatgtaccagaacgcccggtccgtggggctgtacggcagcctggccagccccgtactgcgcacacgtggcctgggcgagctgttgctgaggcggctgctggccagctccggcggcggctgcagggccggagctggcggtggcggcggcggcggcggcggctgcaggacgggcacggcggatgccgctaccagtgcggctgctggcgctgccttggggaccgcgcccagcaccaccacgtatgaccggagcaccgcaggcgatgcctcggtcggtggtggcggcggcggcggcaggcacacgggcggcggcccggtgatggtgatggcgtcaaccgccgcgggcggccccgttggctggggcgcggacgtgtggggctcgggcgacgcagaggctggggcggcgctgctgcagctgctgctggcggtttcggcagggcaggagtacgagtgcctggtccaggtggagccggaggcgctaggcacgcagctggcggcagcagcggccggcctcaccggcgccgcctcgccggcacccgcgccctttctttcgggggccggccccaacatggccagtgccgcgggcgccctggccagcggcagcagcggctcggctgcagcggggtcgggagcggcagcggcaacaggcgcaactgcgctggccctggccctgcgctcacgtccgcatggcggctcgcgctgcggcgcatcagcggcggtggacgcggcggcagcggcgctagcggcagcgcctgtgtcgtgggcgggagaagctgcgcccggggcagatggtgatggccgcggggaggcggagaggtatcccgagctcgacactatagacgcggcgcttctggaggcgttgttgggcactccagcacccgcgcctgcgacaggagcgcgcgcgggcggcaggaatgccgctgacgcggctgccaccggcaccggaatgagcgcagctgatcagcatgatcacccgcaccaacagccgtaccgccgtcatcagcagggccaggggcagcccatcagcgcttccggccgccgcgctttcacccacgacgtgcgccgcccgcgcaatgacccgctgtctgacgagtcaggggccttcgcgtcggcagctggggcagagcattcagaagcgtcggctattctcgactccagccccttcatcgcagtgccgacacccgcgcagacgccccggcctcatgctccaacagccggcgaggtggtgacggcggcgtgcgcgcctgccgcgcccaccgctgcggcacatgacggtggcggaggcggcgcgggagcgcatgcagcgctgcttggcaacttcgctgctccccaaacctctgccgctgatgatgccagtaccgccaccgccgccgccgcggcggcagcagcagcagcagaggcagctgctgtggagcagtggacggtgtgcgcccgcggcggcggaggcggcggaggcgaggggttcggctggcgccgcagccgcacgtccctgccggcgacgccgcgcgcccaccccgctgtagcggcgcagctggtgggctcgggcgtctcgctccacacagcccaggccgcaatagcggaggccggcttgcttccgtggcgctcgcagtacactccatcagcgggcgtaggccctctggaggcgcaccctatcgcggcatcagcggcagtgaccaccgcgctcaggccccccaccactacgcccaaccccacgcagcccagccagtccctgcccgcgagccagtccacacgcggcctcatcaccatgtcgccttacacaaccggacccgctggaatgagtcccgctgacctgtcggggccgtttgcgatgccgccgccgccgctggtgtcgccggcggcgtcgcggccgctgccgccgctcgggattgcctcgaccgtgtcaggcagcggcggcggcggcgcctcataccactctggactgctggcgtgcctgacgccgctgcaccgcggcggctcgcggccgcaaacactcgtcatgtctcagctggtgcaggccggtgcggcggcggcggcgcagcggaggcacagcatcggcggcgccgcgctgcgtcgcagcctcagcgccagcggccgccttgatgcggagggcgctgcagcgatggcggcagcggtcgccgctggcgcacaggcggctggcggaattgggatgtctggcgcaggcatgcgtgcaggggcgcaggtggggaccaccgcggtggccttgtgtgcgggtgcgcagcgcctttccttcaaccctccgcggcaccagtcagctatgggctactcggcatcgcaagggccagccgccaccggcacagccgcggccgtcaaacgggctatcttgtacggcggtggcactggcgctgccggcacagcagccgctgcggccgctgctatcaccgctgccaggtccgccgctggcttctccgacctctggccggcggctgcaggtcccagcagtgacgggagcctgtcctcagcccccatgagctctcagcctccggccctgctgaacgccgtgggttcctttggccgctcgcgactgggccccgggcccgccggcagcggccgcagcttcttgggcagtcaccccggcacgttcatgcccgccgccggccgatccaccagcagcggtggcgtgacgccggcttacgccgccgcggcggcggcggccgccgccgcctcctattctgtggaccaggcaggtacggtgggcccggcactgtcgccgctcttcaccattacggatgaggcggttgtcgagtacggctcagatgacgtacggcttgacggcggctcgacacgcgccgccacactcgacggcaacctccacggcaccggcaacgcgggcagtcatgcgccgagcgccgtcagcgcaagcacccgacgcagcgtcggcagcttcgcgctgctgtcggagcaccgtggcgctggcgggggcagcggcacagcaggcagttgcgcggtgctgtcgccgcctgcggtggggcggcgggcccgcggcggcggcggcggaggccgcggcagagctgcgttgctgcattcctcagcggaggagatggagggactggtgctggtgggcggtgtggagggtgacgagggtgacgatgacgaagacgcggacgcggacggtactcgtcgcgccaacagccgaaacgcacagcggccgcagcaggcacaacagggcgcggcggcggctgcggcgggcagctgcggccggcatggcagcaacaccggcagcggcgcgcttcgggacggtgcgaacggctctgggggcagctcggaaccggcggaggccaccctggcagggagcgctggcgagttcgaggagccggtcacgccgcggtctgcctacgatgcctctgctggcgccatggagtcggcgtcggtgcctatcacgcccatcccgcattccggcctgcggccccgcgctggcccttccgaggctccccagcagctgactgccgccgccgccgcctcggcttggcccccaggcgacgccgcggaggcctcgggagctgtgcaagccgaagacgctgctggcgacgggtgtgtgcgcccgaacctgctgttcccatggaccctccctccccaaccctccgacactgctacctccgcaaatgccgctgtcgccagtcccgcagccgccgtccccaaaccggtaaacacagtcgcagccgccgcggctgcggccgccttgaggggcaacagcggcgaggcgtcgctgggcgtgtcgccggcggcgccgcccgcccttgcgctggacaccctcctcagcgaggattcgctgggggcgctggggcgctttgcaaccggtgtgctttcccctcgggagctgccgtcgctgcagcacacaccggcggaggcgctggagccgccacagcagcagccgggtgcgtcgccatccatgcctgcgcctgcggcggcggcagtggcgaggatgggcagagccacgagtgacggccagcaggtgttgcagcaggtgccgagcggcggcgtgcctcgcactagccgcaccagcaccgccgcctccatcatgcgcgggcggccgtcgctgcagctgagtagctcctaccaccagcatggctcccccagcattgccttgcagacaagatctacgctgcctccatgccaacagcctgacccgcagcaggctttggaccagcagcagcagcagcaacagcagctggtgcagctgcagtccacgccactgcacaagctgggaggcattgctggcagtgctggcagcggcatcggtcgtgtgcgtggcgcggggctgaagcgcaacacaacacgcgaccgagtgcaaatgctcttcaccaacatccgacatcaggagcagcagctgctgcaaggggcaccgggccacggccccgcgcacgtgctctctccgcttggcatttccgcggcgttttcgtcggtcgtggcggacgcaacagttgggactgccgatggccgcagcagcgccgcacagcagccctggtcccccggccgcggcagccacgcggccacgagcatgggcattattgcaggcgagggccgcgtcacgtccttcaggcacagctgcggcggcatgatggggtacctacaagccggcggcctgccgcagcagcttgctgttggtgccggcggcgttggcggtggctgccgtagcatgaccaggtcgggtgcgggcgtggagggtgccgtggcggaagccgcggccgcccaagcggccttgggagctgcgccggcggctgagttttcggtgcccggtgctgcggagctgatgctggcggccggcggcggcgcgggcggcgcaatggacgtgagcggcgcgctgcctaccgtacacagcatcaccagcaacggtagcggccggaagtggcacaccgcggggaccgcagcaagccttgctagtcccgaggggccggtcgcgaatgttgcaagcgtcgccagtgtggcccacgcgccgttcgcggccccgccagcagccggaacggctcggccgtcgttctcaaagcacgccgcggcccccgcagctgcggcgcccgccgcgccgcgccggcagcgctggcaccggatgcatgcggtgctgtgcgacaccgggcagcacgagcgcctgcaccgcacggcacctggccagcagcaggcgcccggcgacgaggcggcgcaagctgtggagcagcaagcggagaaggcggctggcgcgggcaccgtcatgttcgtcacgatcacgcagatcgacgtgacggagcaggtggaggcgcaggcgcagctggccaagctgttggagcaggagcacaaggtgctggagggcatctacccgcgccatgtgatcgagtactacagcgccggcggcggcaagctgattggctctggcgcggcggcctcgggccctcaaggcggcggtgccaacgtggagcgcatggcctcgctggccacgtggcacgagggcgtcaccatcctgtttgcggacattgtcggcttcacggccatgtgccaccatccgaccaccacgcctctgacggtcatggccttcctgaaccagctgtacagccgtttcgacgcgatgattgacatctacaaggtgtacaaggtggagaccattggtgactgctacatggtggcgggcgggctcgtcgcttacgatgacgacggctacaagtccgtcatctcgggtggcgaggacccgctgcatgccgtgcgcgtgatggagtttgcaaaggccatgatgcgtgccgcaagggatgtgcggatgccccataccggtgagccggtgcagatgcgcattggcctgcacagcggccccgtgaccagcggcgtcgtgggcgaccgcatgccccgcttctgcctgttcggcgacaccgtcaacaccgcgagccgcatggagtccacgtgccgcccaggcagcatccacgtctctgcgcccacccaggcgcggctgccgaacgagccgtggcgcgaccgcggcatgacggaggtgaagggcaaggggcagctgcagacatacgagtgggccggggacgtggatgcgccctatgacggcaaccagctgcagcgtgtgattggattgtatctgtaa

SEQ ID NO: 193 - DNA, 3129 bp, Chlamydomonas reinhardtii
atgacgattgaggttggcgactggctctccaagccctctaccggcgtgctaccgccttgtggcgtgttcgtcgagggcggtgagaagccgatcccggtgccgctcaagcggcgcgatgtctcagcgaccgtctacgccgctgcttccttttccgataccaaggagaccctgagctatgtgagcgacgtggagtgctcggcagtcttccgtttccccttgccgccgcgagcggccgtgtacaggttccgcgccgtgtttggagaccgcgaggtcgtgaccaaggtcaagccccgcgccgcggctcgtgaggaattcgacctggccgtgtcgcagggccactcggccgtgcacatgtcccagcacgaggcgggtgcgtccgtttttgaggtgtcgcttggcaacctggaggcgcacaccgaggtgacggtggagttcagctacctccggctgcttgacgcgttcggcggcacgctggagtggagccacaccgccacgtgggtgccgccgtacgtgggctcagcaggcgacgtggcaaccggcgtggacaaggtggcggcggcgctgcccacctttgcgcccaaggtgacctacgtcctctcctacgaggtcacggtgcgggcggaggcgggcacggtgcgtgccattgagtcgcccgagcctgtgaccgtggagcgcccagctgcggctgccgaggccgcggcaggtgctggtgcggaggaggtgtggcgcgtgcgtctgtcggagcaggtcgccgacccctccaaggacctctcgctggcgattgagctggatcccaaggccgcgcgccgcagcggcctgcgtgtgcagcgcacgcccgcctcccgcggcggcgagcagcgcactgttgcgctggccacgtttgtgccgccgctgcccagcccgcccgccgccggcgccgacggcaagcagcagctgcgcaaggagatctggtttgtggtggactgctcgggatccatggacggctctcccatcaaccaggcccgcgaggccgcgctgttcttcgttcgtgacctgcccgtggacagcggcgtgcgcttcaacatgaccgtgtttggatccagccacaactcgctgtacagcaactgcaagccgtacgacagcaagaccgagaaggaggcggttgcctggatccagagcaaggtgcacgccaacctgggcggcaccgagattctgggcaccatgcagcacatctacaacagccccatcgcggccggctacacgcgtgagatcatcttcctcaccgacggcggcatcagcggccacgaggagcaggccgtgtacgacctggtgaaccccaaggccaaggcccccgtgcccgccgcagcccgcacccacgtcctgagcctgggcatcggccacggcgtgcaccgctctctgctggacggcatgtcgactcgctccgacggtgcggtcgtgtacgtggtggacgatgaggcgattgcggccaagaccgcattcctcaagaaggctgccacagccgctggcgccgccctgcgcccgcggctggtggcgcgcaatgcgctggtgcggcccgcgccgcacgtgctgcctcagcgcgtgtttgccggcgagcccctgcacgtgctgatggaggtggttagctctgagcctgacgcggcgctggagctgaccgcggactgggccgagccggagtcagctgccggcgcggcgccgctgactctgtcgctgccgctgggccctgcgctggcgtctgcggaggagggcgaggcgcttcctgtgctgcacgccatggcctacatcggcagcctcatggccggcactagcccgctgcacgtgcggtctgacggcacgaccctggccgccccgccctctgctgacacggtcaaggaggcggtggtgcggctggcggtggccgagcacctggtcacgccgcacaccagcgccgtgggcgtgtcgctgcgccgcgaccccgctgcccccgaggccgctgccaacgtcgtggaggtgccgctgcagctaccacacggccgcaagctgtggggcaccgcctccggcgctgggcccatgccgccgcccatggctgtctgctttgccgcgccgcccatggcgcagcgtggaggcaggatggcatgcatgagcgcgtcggcgatggcgtgtgcgccgatgatggcgtgctcggcggcgccggcggcgccgccctgccccgtgccgcaaatggcgtcgccacagatgatgtggtgcggcactgcgccgggcggtggcggcggccgcggctctgcggctccggctgcgaccaaccaggcgtttgcgtctgcggatctgagcctacgtggcgagaagattgaggcgctgtccgacttgagctgcggcgtgcagcaggaggcccagtgcttcacgaagaaggcgctgaagaagaagtctgccgccgccagcctgggcgacgccgtcggcggcgccatgggctcgctctttggcggcctgttcggcagcggcagccgcggcgcctccgccgtgtgcgccaagccggcgcagcaggcgctgcagggccctggcagcgcaggcggcagctgtgtcgctgccgagttcgccgccccttgcggtgctgcggcgccggaggcggagcaggaggagtcgtgctgcgacgacggcgcggatgagatggaggccggcgactgcgacgctggctttagcgtgccggcgatgaaggagtcagtggcgcggcgctcgcgctcctgctccgcgtcgccgccggccgctgccgcggcgccggcggagcgccagctgcgtggctccgagctcctggctttcctgaacctcaagcgcaccacgcagggctactgggccgccggccccgagctggcggcggcgctgggcgtgccggttgtggacctgacatccgctgcgggtgctgccggcagcggcggcagcaccgcagcagtgctgcgccccgccggtctgaccgacgacgcctgggcgactgtggtcgtgctggctgtgctgcggcgctgcctggcggctcagcgggaggtgtgggcggacatggaggccaaggcgctggcatggctggcggcggcatggccggagggcggccgcagcgtgggaagcaccgtcatggctctggcaaaggcgctgacggtggaggcttga

SEQ ID NO: 194 - DNA, 744 bp, Chlamydomonas reinhardtii
atggcggaggctaactcgcgcgagctcgcgctttacagcgccaagattgctgagcagtctgagcgttaccaggacatggttgaggagatgaagaaggttgctgtgctggctaatgagcaggagctgtcggtggaggagcgcaacctgctctcggtctcctacaagaaccttgtgggctcccgccgcgctagctggcgcattctgcagagcattgagcagtcggagcaagctaagggcaacgagaagcgcgtgggcatgatcaagaggtaccgcgcggtggtggagggcgagctcgacaaaatctgccatgagatcctggacctgctcgacaagtacctggtgcccagcgcctctaccaccgaggccgctgtcttctacctgaagatgaaggccgattaccaccgctacctgtctgagtacaagacggacgaggccaaagcggcggccgcggagttgacgctggccgcctacaaggtcgcccaggagaaggccgacgagctgcccacgaccaaccccatcaggctgggtctggcgctcaacttctcggtcttctactacgaggtgatgaaccagcccgcgctggcctgctcgctggcgaagaaggccttcgatgaggctatctctgacctggactcgctcggcgaggattcctacaaggacagcgcgctcattatgcagctgctgcgggacaacctcaccctgtggacgtcagaaatgcaggacgacgacaagaatcgggcatga

SEQ ID NO: 195 - DNA, 1818 bp, Chlamydomonas reinhardtii
atgccttcggccgctaccaagaagaaggagctggagaagaagaagagcggcaagctttcgaagtcgcagagcacggcctcgatgccgcatgccgactccactgcctctctggcgtccaagggcggccccgtcgaggatgacgccttcagctcccgcaccgtgaccggcgtgctgagctcgcggcccaccgcacgcgacatcaagatcgacggcttcagcatgggcctcaacggctgcgagctgatccaggactgctccatcgagctgaccatcggccgccgctacggtctgattggccagaacggttccggcaagtccaacttcctcaagtgcatcgccaagcgcgaggtgcccatccccgaccacctggacatctaccacctggaccaggaggccgagccctcggagcgcaccgcactgcaggccgtcatcgaccacatccaggctgagctggagcggctgcacgccctggaggaggagattatgtccactaccggccccgaggacgagcgcctggaggccatctacgaccgcatcgacgagctggaccccgccacctttgagagccgcgccgccgagctgctgcacggcctgggcttcagccccgccttccagcagcgcctgaccaaggacctgtcgggtggctggcgtatgcgtgtggcgctggcccgcgccctgttcgctgcccccacgctgctgctgctggacgagcccaccaaccatctggacctggaggcgtgcgtgtggctggaggagtacctgaagaactacaacaagtgcctggtcgtcatctcgcactcgcaggacttcctgaacggcgtgtgcacgcacattatctggctcacccacaacaagctgacgtactacaccggtaactacgacacctttgtcaagacggtggctgagaacgaggtggtgcagatgaagaagtaccagaaggagcaggaggacatcaagcacattaaggagttcatcgccagctgcggtacctacgccaacctggtgaagcaggccaagtccaagcagaagatcctggacaagatggaggaggccggactcaccaagcccgtgcagcgcgagcgcaccttccagttctcgttccccgagtgctccaagctgcctcccccggtgctgccgttcatcaacgtgtcgttcgcttacagtggcaagcccgaggagtacctgtacaaggacctggagttcggcattgactgcgactcgcgtgtggcgctggtgggacccaacggcgcgggcaagtccacgctgctcaagctgatgaccggcgacctgacgccctcggtcggcaccgtgacgcgccacccccacctgtccatcggccgctaccaccagcactcggtggaccagctggacgaggagaagactgtgctggagttcttcaagtccatgtaccccaacacacccaccttcaagcgcgaggaggacgagtggcgtggctacgtgggccgcttcggcatcagcggccgcctgcagaccaccaagatcggcatgctgtcggagggccagaagtcgcgactggtgttcgccatgatgtgcatgaagaacaacaacctgctgctgctggacgagcccaccaaccatctggacattgaggccattgactcgctggccgacgccatcaagcgctacgacggaggaatggtgctggtcagtcacgacttccgcctcatcgaccaggtggccaaggagatctgggtgtgcgaggacaagaaggtgacgatgtggaagggcgacattcgcgactataaggcgctgctggccaagaagatgggcctcagcggcgtgcccggcaagaagtaa

SEQ ID NO: 196 - DNA, 3246 bp, Chlamydomonas reinhardtii
atgggcaatgagggcgaggttaaggtggcggtcaacgggacctctattgaggaggtcaactttgagaagattgatctgaaggaggcgctgtcaattctgaacacgacgcctcatggactatcctccgcggaggcagacaagcgccttgcggagtatgggccgaaccgcctgccggagagcaagcgcattccgctcctggtgttcctcggctacatgtggaaccctctttcgtgggctatggaggccgcggccattatcgctattgctctgctggattacgctgatttcgccctcatcgtgggcctgctgttcctcaacgccgtgatcagctacgtcgaggagtcgagtgcggacaatgcaatcaaggcgctggcgggagcactggcacccaagtgcaaagtcattcgagacggcacgctacaaaccatggaggcggtcaaccttgtccccggcgacgttgtggtcatgaagtttggtgacatcgtggccgctgacgtgaagctcttctccgacgacccgcagcatccgttcgattcacactctgaggaggtgcccatgcagattgaccaggccgccctgaccggtgagtcgctgcccgccaagaagcacaccggtgacgtcgccttctctggctctgccatcaaggctggcgagcgccacgccgtcgtgtacgccaccggcatcaacaccttcttcggcagggctgctgcgctgatcagcggcacgcacaacgtcgccaacctgcagatcatcatgaccaagatcggaggcgtgtgcctggtgaccatcggtgtctgggtggtgattgagctggccgtgcagttcggccactacggccacggctgcacttccggcgaggagggctgccccaccctgaccaacatgctggtgatcctggtcggtggtatccccattgccatgcccaccgtgctgtccgtcaccctggctctgggcgctgccaagctggccaaggagggcgccattgtggcccgcatgagcgctgtggaggagatggccggtatggacattctgtgctcggacaagaccggcacccttacgctgaacaaactgtcgatcgacatgaacaccatctacaagtgcgagcccggtatcaccaacgacgacgtggccaagtacggcgcgctgtcggccgacgttgccggcgaggagcccatcgacatggtgctcttcaacaactacgccaacgccaaggacctggccgcccgttacaagaagatcaagtgggtgcccttcaaccccaccgacaagttcaccgccatcacgctcatggaccaggagaccggccgcgtcttccgcctgctcaagggctcgccccaggtggttctgggcaaggcgtacaacaaggacactctggccgacaacgtgaacgccaagatggtggagttcgccaaccgcggcttccgctccctgggtgtggccatggccgagggcgatggcgctgacggcaagcacgagtggcacatgctggcgctgctgcccctgttcgacccgccccgccacgacaccaaggacaccatcgagtactgccacggccagggcattgaggtgaagatggtgactggcgaccacctgctgatcggcaaggagaccgccaagatgctgggcatgggcaccgtcatgtacccctcggaggtcctgatcaaggccaagaacggcgacaagggcgccctgggcgacttccgcgacgtgacccacatggtggagtcgtgcaacggctttgctgaggtgttccccgagcacaagtacgagatcgtggccatcctgcaggaggccgaccacgtcgtgggcatgaccggcgacggtgtgaacgacgcgcctgcgctgaagaaggccgatgtgggtatcgctgtggccggcgccactgatgccgcccgcggtgccgccgacatcgtgctgaccgaggcgggcctgtccgccatcaagaccgccgtgctgggcgcgcgcaagatcttccagcgcatgaccacctactccaagtacacggtggccatgaccttccgtatctgcttcacctttggcctgctgaccgtcatctacgactggtacttccccaccattctgattgtgatcatggccgtgttcaacgacggcgccatgattgcgctggccaaggaccgcgtggagcccagccgccagcccaacgcctggaacctgaagaacatcttcctgatgggcattgtgtacggcctgtacctcaccctgtccacctgggcgctgtaccagaccgcctgcaagaccagcttcttcgaggaccacttccccatcttctcgctggacgaccgccacatcaccctgcagaactggtgcaccggctacatcaccaaccagctgaacctcaacccgaccgccagcatctgcaccatgcccacctacctggcgcagttcgacagccaggcggcttgcattgaggagatgggcggcgagcagatcatcaaccagtgcatggccgagcagcgctacatccgcggcgccatgctgcgctcgctgatctacaaccacgtctccatctccggccaggcgctggtgctggtggtgcgcaaccagggcttctccctcatggagcgcgccggcagcctgacctacatcgccttcgtgctggcccagatcggctccaccgtcatctcggtcttcggcttcggcggctacgtgccccctcgccaccgcttcaccgactgccagttctgcagctactctgactacacccccgtcaagttcttccccagcaaggaggtgcccatggccggcaccgagtcggtgtacacggcctccgtgctgggctgcctgggctacgtgctggtggcctggatctggacgggcatctggtacgtgctgctggaccccatcaagtgggcgctgtgctggatgctcaacgaggacggcttccgcgacatggccaccatgaagcacgagcgccgccaggagctgggccgcacctcgcagcagaaggccgccgacgtgggcgtgaccggcatgaccgtgcccaccgcctccaacccgctgggccgcgcctcgatccagaagcccgtcaccatggtgctggaccgcgcctcggccgccctggtgcccgtgcaccgcaccagcgacggcctggtgcgcgtgtcggccgaccccgccaaggcccgcgacctggcgcgccgcagccgcctgaacgagggcatgcagcgcaccagcggcggcgcgcacgctgccggccacaccggccagaaggagatcacgcgcgcttaa

SEQ ID NO: 197 - DNA, 1563 bp, Chlamydomonas reinhardtii
atgaaggatgttgccaacaaggaccatatcagcagggtcgaggtgaccatgaaaaaccatatcagcaggttcgaggagaccatgaaggaccatatcagcagggtcgaggcgaccatggagggccatatcagcagggtcgaggagaccatgaagacgggctttgtggagcagcagaagttcttcgtgctgctggcgctcgcgtttccggtgctggttgcaatcttcctggccctgatatttggggctatcacgcagtttcccgtggaccccagcagcgtagtcatggctcagatcatgggcgctgtagcggcgctgatgcgggtgcagttcgtgagcggcacacacgccatcgcctcggcgctgctcccgcccgcctgcactctcgcctctccggcaaaacccccgctggcgccgaccgacgctgcgctgccaccgccgtcgcccgcacccgcacccgcggccctccaccccaccgacccgcgcaacaagaccgagcgcttccgcctggtgctgcaacagcccgccgccttcatgacgccggagcttcgggaccagctgcggcagcgcgtgctcgtcatcgtgcgcggctacctgtcctcgctgtaccgggcctgcctgggcgcctacctggaccaccaggccgccgccgcccaggcgctgggcatgcgagtgctggtcggcaacatctgctgctgcagcacctccgcccgcaacagcgcatcgctggcggcccagatcgccgcacacaccgccccacacgaccgagtcatcatcctggcacacagccacggcaccctggccgccctggacctgctgtgcaacccggcccacgccgccgtgtcgcaacgcgtggagtgcttcctcccccttaacggcgtgttcggcggcacgcccatggcagacctgtgcaccagctcgagcctggtgagtgcggtgctggaggcgacctggggccggctgctggcggtggtgggcggcggcgaggcgggcgtgctgcgcgacatgacggcggcggcgcgccgcgcatatcacgcgcaacacggcgatcgcatcgcggcggtgctgcggcgcgtggcggtggtggcgctggcgtcgcactaccgctggccccggtggccgccgccgcggctgctgcgggttgctgctgtggaggcggctgtgggtgtggccctgctgccgcagcgcatggtgatggacgcgatgggctgggcgcccaatgacggctgcgtgccgctggccagccagctgctgccgggcgcggcctacgtggtgtgtgagggcctgcaccacgtgcacaccgtggacgacctgggtgcgctggacctccgggcgttcacacacacgctgctggtgctggcgtcggaggcgcggctggcgctgatgaaggagcagggagaggaggtacaggggcaggcggagcgggagcgggaggagaaggaggcggagggtggaggtggaggcaaaggtggtggtggaggtggaggggcggcggcggtgcaccggcatgaggaggaagtggcgcggcgcctgctagcgcccggtggcgccggaggtggagattaa

SEQ ID NO: 198 - DNA, 5040 bp, Chlamydomonas reinhardtii
atgttcaaccgacggaaaagcgcggaggcgcggcggagcctggaagcccgcgcccggcactcggaggaatgggtgtcggacccgcctgtggccagcggacaggatatggagatacctttcgggctgcggcatgattcggaaatcggggccggtattatgcaccaggccgtggaccgagcctcaagcagcgtgcagctgcgaggcacaacagatgccgccctgtcgctggcaatggagctgggcttcacgataggcaacgacgacgaggaggacgagcaagaggagccgggagagccggggactgagttgcaggggcaggttgaagatgtggaggatgtggaggaagggcagggggaggaggacgacggggatggggccgaagatggcgaaggcgaggaatggacgtacgacgacgcaggcctcgggcccttgcatcggcccatggaaggcgaagaggtgcgcactggtttgtaccgttcggcgctgttccagcaattgcagccaatgccgcagctcccgcagacagcatttataaccgggaacggcgaggcgagcgaggttggggcacggcatgacggcatcgactctgtcgttgcaccggacgtggagagcgagcttgctgagggcggcgtgcccagcgccgcggctggaccgcagcagtcggcatctgcccccgccctcgttgccgctgcagccgcggctgtagcagcaggcgggagcggcgccatacgcgcgagcgtgggccgcagcggggccagcaatggcgcggggcacggagacacaggcggcagctcagggcttgaggcagtcatcggttttgccgggggtcgaggcagcacagccccgggacctggcggcagcggcatggcaggggacttggagtggccggggacccgtggcggcaccggcagcggcacgggtatgggtggcaaggcgctggcgagcaacgtcgcgccgcagtcgtcacggcacagcctggtggtgcgaaccagtgccgcgcccatgttcccgcagcacacgcagcacccggtacaccaccaccacctgcaccaccagggcaaccactggtcgccgctcgggccgtcgccgcacgcttcgggcctgagcctggcggcctccgcgccgccgcacacccagcagcagcctgcgtcccccaccgtgcagcgcattgcgggccgtggccgaggccgtggcctgtcgtacgacggcgagaacggcccggcactttcgtcaccaccctcccagccttcaccagacgtgcggccagatgctctgcagcaacagcaacagcaacagcagcagcagcacccacagcctgcaccgcagcagattcagcgggctgtgttcctggacatcgttcaacgcaagccctgggtgctcctggtgcccgtactcatgtgctttttgatcacggggctgggcgtgtttggagtgctcttcgcctcggtccgcaatataagctcccagcagaactacgcgcgggaggccgtggcgtccgcaactgcaaacgccatttcgggccagctggaaatcgcaacttttgccgtgatgaccatgtctgcctacctcacgcaacagcccttttgcgccgacctcaaccgcaactttaacaacctgtcttcagtgattttagattgggacgagaagcatctcgtataccaggtccaggcgctgccggccgcggtgctcaactacatctacccgccggtcagcgacccagaactggagaaggtgctcattggtcgggacctgttggaggtgcccatgtaccgcgaggacacgctgtaccagatccgagcacgtgaccagcgcctgatgctggggccgtacgcgctgctggaggggttccagggcatgttcgtgacctaccccatcttcctgcccgcaccgaactccacctttgattggggctgcggcgtcgagccgcacgactgcccgccgggcgtgtgctggctcgcgaaggagggcctgaagctgtgggggctggcgacctcggtcgtgtcgctggacaacatgcaagccgatttccggtttgcgacgctgagctcgcagggctacttgtaccggctgcaccagctgccgcgcgcgcccaatcgcgccgcaaccatcgccgcgagcgacccgcttcccagcgacccagtcacggcaactgtggcgaagttcaacctggtgtgggtgctggaggtgtcccctgcggcaggctgggtgcccgagtggcgcgacccgtgcattgtcgcggtggtggtgggctctgtggcggtgtcgctgttggtgctgtggctgctggtgacgcgggagaaacacaacatgctgctgcaagccatgctgccggagaaggtcatctggcgcctgcagcgcggcgagcagacggtggtggaggagttcttggatcccgtcaccattctgttcagtgacattgtgtcgtacacggaggttgcctctcagctgactgcgctacaggtggtgcggctgctgaacgagctgtacacacagtttgacttgctgtgcgataagcacgaggtgtacaaggtggagacaataggagatgcgttcatggcggtcgcgggctgccccactcgcgaagagcccatagccgcggccgtccgaatggccaacatggcgcaggacatgattgccatggtggaggagttcacaacgcgcgtgggcgatgaggacatgaaagtcaagatccggatcggcctgcactcggggcctgtggtggcaggcgtgattgggcagcgcatgccgcgatactgcctgttcggcgatacggtcaacaccgccagccgcatggagaccaactcctcgcccatgtgcatccacatctccgcagccaccgcctcgcttctgaggctggcgggagcaaaggtggtcatgccgccgcgcaacatcaagcgcgccgccgccgaccgccccgttgcgccggtttcgccactgcgcatgggcctgccgtcggccggcggcctgccctccgccctgtcacttctgggcgcacttcccagcggcatacttcaaaacggcacaggccgggatagaacgccgagcgatgtcggcgtggcccacctgccgccgccctcgccgcccaacctgtcgctgctgctggagcaacacgaccaacagcagctgagcaatggcgacatgtggcacggcggcggcggcggcccggcgggtggtgccggtggcggcggaggcatgaacgctgccgcgcccacggcccatgcctcccgtcagagcctcatcaacttgagtgacacagcgttctcagctggaggcgcgggtgcggcgtcagctgccgcgggcgcgcagcagtcacacccgccagcagccggacccacccagaagcctcacatgcagcagcatccacatcccagtggcaccgccgctgctgtggccccgccgcctgcatcgcagctgtggggcggcggtgtgggccgagagcgcaacatgctcccgatgctggacaagccaatgacattgttcggccgtggccggaccatgatcaagggcaaaggtcacggcagctgccgcccgtccgatgccggcagcagcaccgacttcgtacggcgcgttaccaacacgacgaacggtggcggcctgacgccgccgccggctagcggggccggcggttacgctggaggttacggtgcatgcggtggctacagcggagccgctgctacggcaacggctgctaccatggtcgtgccccatggcacggatgatgcgggctctctgtcggcggcagcggatctgctgcagtcgggcatgcaggcggcggtgatatcggcagcgggggcgggggctcagcaccagcctggcctggcgggcacgacgcagtgccggtcgcctctgggccgcaagcgcagcgtcagcgtccactcctacacctctccgtccccaacacagcagcagcagcagcagcagcagcagcagcatgtgtcaaggcagcggctgccttcggcgcaggcgcccacgctggcaactggcggttcatcctctgggcaggccccgcccggcctttcctccggcacggcggcgtcggtgctggcggcagccatggcgctggggccgcacggacaacaccagcagcagctggcaccagcacccaccgcagaaacaggcctgctggcaatgacctcgagcgccgccagcttggaggacattgcctttccggtcgccttcgacccgcccattgcggatgcgcgcaacccacagcataccgggacgcgcgccagcaatttgctcacctctgcggctgaggccgctgcgttcaactcggccggtgcagctacctccgcagacccactgggtgcggccagtagccccgaccctcgcatggcccgccgcctgcttggcgctgccgtgtgtgacgcctgctcgagcggcgagtgcgagcttgcgattacgggtggctccgtgtcgaggggcggcgcagcggagcatagcagcctccgcggcctgctgcgcccacagcaggcgcagcaggtgcacacggagggtgcgcacagtggcggcggcgccggcggcgctgacactttccatgatgaagcggcgccgcttgggctgcgggcgctgggcctaagtgcgttttcggccatggcagaggacgcgggcgtggcaatggacgtgaacgccacgtttgcccactccgcagcccacctgcactccagcaccatcatttctcgcctcggctcgacgatagcgattgcaggcggcagcgaaagcggtcataatggcgcgcctggcttcgccgcgcgcgccaacgccaacgcagcttctgttgctggagacatgacagcagtgaaggggaatgggccggcggcgtttcttcgcattgatgggattggtggtgggggcaacagcggtggcgacataagcagctctgtcgggtccagagccggcgccgctcctatcgctactcgggctgtggctgcgctgtcagaccctacggatatgactggcgtagcgcaggcggagcgggaggcggaggcgcacgcagcgaagggaaagacgggggcagtggctgctgactgccgctcttga

SEQ ID NO: 199 - DNA, 2570 bp, Chlamydomonas reinhardtii
atgtcgctcaccccagagctcatcacgcagtttgggcttctcggcaaggtgcgcaccgggcatccagtcctggacgccgtgctgtgcatgctgctgccgctgttgctgcgctgggcgcagccccggctgaaccgctgggcgctgctggcggcggcagcgttgcggcggtggtggtcgggagaggcggggtgcaaggaggtggtgcgcgtcatcgagcacgtggcggcggaggacggatactactacgaccccgacggccagcccgcgaacgccatcctgcagcgagcactgttggcctacaagcggcgccggcggctcgcagcagctggcggtgatgctgattcagactcgggcgatgaggattcggcggcaggcagcagtagcaaaagcagcgactgcggtagctcagtgggcgcggccaagcagcgtgaggcggcggcctacgggctgaacctggcgccgccggtgcgggtgtggcaggagctgggcaatggagtcgagtttatgcgctacacgtacacgcacgacagcagcaccgagaagcgccgccgcatcgcctccgtcatcaagctgcgcagccgcgcacccgacggcgcccgccgtgtgtctgacctcatcaccgcggccctgcagcgctaccggctcagcggcgagaagacctttgcctccttcttccacccggccaagtccgaggtgctgcggcttgtgggtcagttcgaggggcggcaggggcgcttctcggtgcccggctacccacacaagctgggactgctgctgtacggcccgcccggtacaggcaagaccagcctcatcaaggctctggcgcagctcacgggtcgctccgtggtgtcggtgccgctggcgcgcattgccaccaaccaacagctcatggacatcatgttcgacacgcgtgtgctcctgcagcgccgccacaactcgggtggcagcggcggcggcagcaagcggagcggcggaagcccccccaacaacgacttcggccccatgtgtgaggctgaggcagtggccctggctgccgcgctggcggagtctatggctggctcccccaacgccgccgccaccgccaccgctaaccatgccgctacagactacgccgccggctactccatgtattccagccaccggtggccctgcaaggacgcgctgaacctcgccggcatcctgaacgttctggatggcgtggttgacacgcccggccgcatcgttatcctcaccaccaactgcccggacagcctggacccggcgctgatccggcccggccgcatcaacaaggtcctgcacctgggtcggctgcggctggcggaggcgactgcgatgatgcgccactactgcttcccggctggaggcgacatggcatcagccggcatggatggtctgactagccgtacagccttcctgacggacgcggcgtgttggttccgccacatggagctggacacagtgtcgggcctggacccggagggcatcaagctgcgcgccgcgctggggctggaggcggttgactatttcatacaaggctactgggtgtggggcaagctggtggaggcgctggctgacgtggggtacgacagcaacagcctagtcagcatgccgtacgactggcggctggccgtgccgctgctggaggagcgcgatggctactacacgcggctgcggcgcaccatcgagcagcttgtggagctgacgggggagcgggtggtggtcaccagccactcgtacggagagaacgtggtgcggcagaacagccggcgccgccgtctgtgcggcgcgagctgtcgtgcgggcgagacacgcgacaccgcccagctcggggccctggcgggcttcctgacctccaacatggtcccgcgcgccgcccgcacccgcgtgtggcgcagctggggagcctcctacgccatgctgcctgtgggcgggccgggcgtgtggggcaacgcctcctgggcgcccgacgacacgcccgagatgcgggccaaccgccgcacgttcggctccatggtgtctctgtggccgcacaactggcaggcgctcatggccgccgccccgcagcagcagcgcgagcagctcagccagctggtcgccgaggtcacacggctggacgtgtcggggttcatcgcactgctgcgagaggtgggcggccccctggtcagcgccaacatcgcgcagtggggcgcactgcagctgccggcggaggaggcagccgaggcggacgtgggggtgcacatcagcgacggcgacggaacagtgccgctgctgagcctggggctcatgtgccgcggcggctggcgggaggcggggcacctcaacccgggagccatgagagtggtgggtgcggggcgggtgacccgggagtacaagcacaaagccgtgtcgatgcttcaggacgcaaggggcggccccgctgccgccgcgcacatcgacatcctgggcaacgacgcagtgctgcgggatgtgatcacggtggtggcgggccgggcggatgagctggcggacattgtcgtcagcgacatagaccgcatcgcagccgccgtggactgggccgcactggccgcctg

SEQ ID NO: 200 - DNA, 3129 bp, Chlamydomonas reinhardtii; identical to SEQ ID NO: 193

SEQ ID NO: 201 - DNA, 22044 bp, Chlamydomonas reinhardtii
atgaggaactttagtttgcgctgctctgcgctgctttctatattagcggcgggcgcgttgcttatgcctgtgtcagcccaataccaactgcgcctgaccgacgactatacacctgcgaacgccgttaagtatgagggccgagtggaggttgtctcgccgctaggctcgatttgcagtttcggcgagtttgatgacaaagatgctgcggtgatctgccgacagctcggcctgccaacggcgagagccagggcgctgtaccaggcctacaagttcatgtcgggcccctggaacgacccccaggccagcccgcccgaggtcttgagcctggtctcggcgggcgctccgccgatcgtgctgacaaacctcaggtgcaagggcgatgagacgaacatcggcagttgtctgtccgacacctccactttggcgctgtcggcctgctcccgcggccaggcggccggcgtccagtgttttgaagaggactacacagtgcgcctcatgacaaactctgtcaaccccgccaacgcgaccgccgtggcggcgctgaccgaggggcgcgtggaggtgtggctcggcgaggggtggggactagtcggggcgaccaatttcggtcccgacacggcacgtgttgtctgtgcccagttgggcctgcccgtgagcggcgccacggtggtgcccaatggagccgcggcatacggcgccccagcgtccaacacggctgttgtccttgacgggctggcgtgcagcggcaaagaggagaacatcggtttctgcagtccgcccagcaacacgccacccaggggcacggccttcgccgccgtggcgtgcaggcaggccgacttttctgtgcggctctcgggtgaggtctacaaccgaggacagtggggcacggtgtgccttggtggcttcgaccggtctgcactgttcactgtgtgcgtccaggcgggctggcgtacctcggatgcacgaaggccatccttcaccgccttcaacgccagtcgcctgcctgccgacccacgccctggcaccggcgccaatgcactgacgtctctgcgctggtgccctgacgacgccgagagcatcacgcagtgcggggagtacaagtatgatgcggccgccacctgcccggccgggctggacgtggtggtccggtgctacgagtcaccgccgctgtcgctgaacgtccggcccacgtcgctgtgcaccgacccatggaccacctccgccaccatctcgccccgccccggccgcaccaccatgctggtgggcgagttcgatggcgccagcggcggagcgcgcggccaggacgtgttgctggccagctacgcaaatgacggcaccctggttggccacgtggcctattcgcggccctggggcagctccttcatcgcagaggcagacattaacctgggccccacgcctgaaccaagggctcttgtgttggcagacctcaacggtgacggactcgatgacgtggtcgccatcactagtgagcttgtttcggtggcgacagcgaccagctcgcggagcttcacccccctcaccgtgtggctggacctgtccaccacctcggacagcatcgatacctccaacaccaccacccgcgcttacatcctgacggacgtgacgggcgacgcggccgcggacctggtgttcttcgaccggcccactctgcgcctggccttcttccccagcaaccgcatcagccagctgatggacgacacggacggcgagggcatcacgtggtttgagctgagcaccatctcggcccgctgcaaatcgctgggcgaggactgcttcctgctggcggccgacgtcaacggagacagcctcaacgacgcagtgctggtctacctcgatcgtgtcacggccgaccaagaggtgtacatgacgtttgtggccgcctcgccgcccgcgcccctcacctggcacatggccgcgcccgccttcttcccgcgcggcgcctgcacctcgccctgggcggtggtgatggggcagttcgtggggccggacggctccatcgacaacgtcaacgccggcagctccgtgccccaggtggcctgcatcagcagcttcgacgcgcgcatctacgtcgcgggcctggggtcctggggcgtggtgccgggccctcccacccgtgtacacgcccgtgacgtggacctggacgggcgcgatgacctggtgctgttcaccgaggccggctcctactacctgctcagcaccggctcggccttcgagccgcccgtgtccacggcgcgattcggcgacggctacaccgccagcgtgcccaccagcggcgaccgctcgctgggcgagaccgaccagaccgcgtcgaccatcattgcctccagtcagccggtgggcgatgcgcccgtggagcagcgctgcggcgcgcccgaccgcgtcatcgcctacttctccaaccggcgccccgaccgctcggccgcctgcaccgccgccgcttccgcggacccgtccgtgtcccccagcgcgctgacccgcgccgcctcctccgccacccacgtgatcttctcgcgcctgctgccggacgcggacgcactggacgtggcgctggctaacgaccgggacgggcccgtgctcgccaacctggccggcaacctgcactcggccagccccggcaccaaggtgctggtgtcggtgggcggccccggcgccggctccgacgcgctgtcgcgcctggtgctcaacgcgcagtcggtgggccgcttcgccaacgccagcgccgactacctgcagcgccaggggctggacggaatggagctcagctggcccgagctgcgggcggagcaggtccccgccttcctgtcgctggtgtgggcgctgtcgcacgaggtgcgcgcccggcgcgggctgctgctgggcctggcggtgccgccgcgggccgtgtacctggacctgccctgggcgggcctgggcgccgggctggacctcatcaacttccacgcctttgacctggagggcgacgaggtgctgggcgcggcgccgtacgtggagacgccgctgttcagctgcctggaggccaccgggctgtccgtcaacacgatgcttgcctccggcgcgcctccccagaaggtgactctggtggcgtcggccctgggccgcagcttcgtgctggacgcggacggctgggtgggcggccccggcagcgccggcccctgcctggggtccgagggcctgctggaccaggcggagctgcggctgctggtgccgccgggcggcgcgcagctggacaccgaggcattcgcaaacacagcgcccttcgcaggcaaccagtggactcacttcgacgacccgttcaccattgccaacaaggtgtgctttgcgcgctaccactgcttcggcggcatcgggctgtgggacgccgacgccgactcgtttggggcgctgctgggcgccgccgcgtccaccgtcaacggcgacccagcgctgtgcagcgagtacgagacgcccgagtgcacaaacacggtgtcgtcgtacggcaccacagacctgggtcagcccgagctggtgggcagtgtgggcgacgccgagtacagcctgttccaggtccgcaagagctggtcggacgctcgctcgcactgcaaggctctgggcggcgacctggctgcagtgaccagccgcagcgaggcgggcgtgctgtacagcctgctgagcaactgggcgggcagcgggcagctgggggaggcggacgtgtacagcggccgcgacgtgttcgtgtggctgggtggcagcgacgcggtgcaggagggccgctttcgctgggtcaacaccagcgccgacctgacctacacggcttgggcgtcaggccagccggatggaaggtacggtggcgaggactgcatggcagcggccatccggctgggcggcagcagcggcggcggtctgcgcatcgtggtcagccaggaggcgcagtggtacgacatgggctgtaccgcagcgctgcccttcgtgtgccagcgctcccgcgctggcggcatgggcgttgccggcgtcaagctggttccgtacctgaccaccagcctgctggtgttcccgccgctgaaccggggcgagccggggctgcagctgaccatggcgcagggccagaagctgtgccgcacctacggcgccgagctgcccagcctcaccgactactggacgcgctcggacatgacgtcgcccacgggctggtcgctggacctgccgccctacatgtggctgggcctgcgcagctacggcgaggggcagctgttctggagcgacggctcgttctccacggacggcgtgctcaacgcctgggagccgggcgagttcggggacgccgcctgcgccatcatcgtggggccgcagggcgtggagctggagctggaggtggactcgctgtacagccgctggaacgccactgccaccggaggcgccctgagccagggcgtgtactcgctcagctgccaggagcgcatgcccgtggtgtgccagaagagctctccgcccgtgtccctgtcgcccaccttccactgcctgacgcgccccaacggcctggccttcatggtgcccggcgagacgctggcgcccggcggcaacgcgctcacgcccgtggccagcgagctggagtgcgccgttgggtgcatgattgcgccgcgctgcgtctactacatctacctgcccggctggcgccccgccggctgggtgccgcccaacaaccagccgccggaggacttcgcgccaaacacctgctacctgatgggtcggccctgggtcacgtcctgggcgcccaagaagctgtccgaggtggtcaccgccgccgaccgcgtgtgcttccgctccaactccatcttcagcggcgacaccgcgcccatgtccgacccactcgtgctcgacccgcccaccgccgccgggccgctgttcggctaccccgcgccctcgcccaccgccaccgcccttcccttctcgctgctgtgctcgcccaccgccggcgccccggtgctggcgtcagtgagcctgacggttgccaacaccagccgcaacacgcaggacgtcggggtagggtgcacgggcgcggacggcggcggcgcggagcagcggctgtggctgtaccgccccgctgccggcggcgtgtacgaagcggaggcggactgcgggctgagcggcgtgcagggcgtcagcggcgccttcgatgcggccggactgtgctggctccagctgcagtgcggcagtggcgcggtgctgccggtgctggcgccggccgatgcccggcccggctgccccatgccccaggcggccggcagcggcggcggtggcaacttccagtacacctgcccacccggcatggtcggcacggggctgcagggcagcgccctgtccgccccctcgcccgccaccaactccatcgccacgctgcggctcattgcttgcgcggctcaagccacacgtatgtacggctacaccttgatatctacctacataaatccaatgtcacccacgctctacgaggtggcgtgttattgctactcaaatgtgccttctggcggcacggtcgacgccgcaactacagcaacggccgacgtggtttccggatcgttaacttatcgctgttctggtggcgtggtgcaatggcccgcaccgccgcctccacgacctcccccaccgccgttgccgcctaagtgccgcagcactcacaacccggaccgccaccgggcccgcttccgccgtcacctcggccccgatgcgcccgcctgctccgactgctcgccctggtttggcgactccacctcggactcgcccttctacagcagcggcacttacggcacgcagcccaacgccagccagccctactcctcgctgtcggccgcgtgcacgccgctgctgcccaccccggccggacaggaccacaccgtgcgggtgggcggcggctggctgccgcccagcaacgtgacgttcagccagacggccctcaatgcgaccgcctgcgacacgctaggcggcatcgcctcagtcgtgggcgccttcacgcacttcacgccgcagcgccccggcttcatcaccgccatgtccacaaggtgccgcctgaccgcaaccccgctggcgcagccggccctgggctcgccctttgtgggctggaacttcacctgcccggccggcctggtggtggtggaggtgctgtgggcgcagcagaccttgacgcggcccggactcggcccgctgccgctgatcacacgcgtggcgttccgctgcggactcagcgccgggctgctgccttcaccgcccgtgccatacgtatcgggcttcacggccaccgagtcctcgggcctggagccgctgtcgctgctgtgcccgccgggcgagtacgtgacgcaggtgtttggaagcacacgtgtgtggcatatgcccgtggcccatgcccgcctcaggtacgacgtgcccaccgcgctcagcggcgtggcgctgttcatccgcgacctgggcctggtgtgcagcggcggagcggccgtcacaaaggacctggacacgggcatcgccaccgtcaacagcagctctctggccttcaccaccgccagctgccccgccggcatcgcggtgctcaccggccgcgccctgcgccacccctcgccgcccgcgcccagcgcgactggcacccccggcctgatgctgagcctggacgcgctgtgctccgacaccgccgaccacacctcgcgcctcacctactcaccgctgctcagcaaggcgagcgcgcggcggatagcgggctccagaacctggcataagatacctcctacgtgtttgcgtcatcccgatggtacatgttctaacagctccgtcccttgtcgcaatcatgccacgtacctgctgcaggtcggcgagccctactcggagcgctgccgtgagctgacgctcctgtccggcctgagcctgctgcgctcgcgctgggtggtggggggcgtgacgaccggctacctgcacgggccgcggctggtgtgcatggacgtgcccgagcccgaggcgcggctgcccctggcggcccaactgcccacggtgggcggcgtcgtcagctcgcccgccacgcccttcctgtacgagtgccccgagggctccaaggccgtgtcggcgctggcgctcatggacgcctcgggagatgtgctctctttgcgcatcgagtgcgacaacgcgccgctggcatctggcgcacagacctcactgcaaagaattgcagcttccggcgtacccaacacacccatcgtgtccaacacggtcatcaacgtcaccgccaccggtgacttgacaccgatgaacgccatcaacaccaccgccaccaacaccaccggcaccggctcgagctcgggctccacgccgcctcccgactccggcgtactccgctacatcagcccggagctgatcccctcgccgccgcaggcgtcctacctgctgcagcgcagctgccccaccggcatctcgggcctgagcacccgcgccagccagacggacgtggcgcagctgggcacagcggtggtgccggtggcgcgcatggacctgccggacgcggcgccggccggcagcaccgcggcgctgtacgacgtgctgctggactgggggcaggcggcgctgttctgcaggaaccagggaggcagcctcatcaccttcaccagcaacgtccaggtggcctcggtggcgctgatgatccaggagtgggcgttcggcagtgttgtcgacgacgtgctgggcgtgtgggtgggtgccgagcgcacaggccctggcctgtacgactggtcctgggtgaacggcaccctgttctcggccagcttcgtgcctgcctggggcgccaaccagcccgacgacgcgggcggcgtggaggactgcgccgagcttggcgtcaacgtgaccgatgctgccgtggactggagggaccggggctgcactgggttggtgcgacggccgctttgcatgctcgtgcccaagtcggcgcaggcaggcgtgagctctagcgacgcggcggtgccggtggtggcgctgtcctccaacgacggcgccgacatcatcagcctctacaatgtgcagctgccctgggacgccgcatccacattctgccaacgccgcggcggcgcgctggcgtcgttcgatgcgcagttggagatccggcgcctcagcctggcggtcagcgcctacatgcagcccatcgccacgcagcccggccccgtacaggcctggactggactgcgcgcccgcctgccaagcgccggcacgatcagcaccgccctgcgcgcggcggtggcggcggtgcaggtggggtcccgcgagttcctgtacgtgcagcagcagcgcatgagcttcgaccaggccagcgcctggtgccgcaacgagggcggcgagctggcgtccataagtggcgatgagtatgacgccaccgtgtcggtggccttcgagcccgccgtcaacacactgctgctcgcacagcagcccgtgccgcccgccaccttcactgccaacgcctggatcggcctgtcgcgcgtcggcgctggcgcctggacgtggctggacaagagcccctacgtggcgagccgcaccatcatcgatgccgccaacaccagcctctcgtgtgtggccctggtcaccacctgcctcaacaccaccggcagcacaacctctgcgcccatcaactgcagcagcagctacgtggcagtcagctgcgccaacgacagctacggcttcgtgtgcgcccgacccacggacgccgcagcgagcgccatcgtgagcgggcgccacttccggctgtacccgcagcgcctggcctggcaggacgcggcgcaggcctgcaccgaccggggcgggctgctgggcaccttccgcacacaggacgagtacgcgcagttcaccgctgccgtgtccaggtcgcagccgctgctcaacgctacgggcctggccttcattaacgccactttgggcaccaaggccccggggttcatgcatgtgggcctcagcaggcggtcagatggctcattcctctgggttgatgacaagccttctcctgcaattaactgggctgcgaaccagcccaacggcacggcccagcagcgcgaggactgcgccgccttctccgtcatgtgcaacaacttcagcggcggactgtggtcgaactgctcgctacccgagcttcatgactcggagtgctctctggcggcgccgtacgtgtgctccttcgacttcatgtcggcgtggggctacagcgatggcaccgcgctgatgtcgcagcagccaggaggcatgggccccgtcacgccaatcaactatgcctggcaaagcgacacttgtggcgacatgctgaagaacacgcactacggcaacctgctgcctgacctcgccgtgctcaccaacgttgccaacgccaccgcttgctgtcaatcatgctcggcggtggatgggtgtgcctggtacacgcatgactccgccgcgcgcacttgcgccttgaagcgggacgaggggcctggccgccttgtcaacaacaccctcgcgcagtacacgaccgggccctcggggcggccgcgtgacctcatccccggcctgttcgaccccgcggttgccctgaccgactgcggcgccctcagctcgtctctgacgcagaacgtgtccgcgcccgactaccgcttcatgcctgtgaactgcgccacgccgctgccagtggtgtgcaagcggcccgccgggctgctggacctgacgcagcagcccaccgcctcgggcggcggcccggagctgccggaggaggagcggcttgcgctcagcacctacctgacgccgctagccaccggcttcaccagcgcgggcacggtggagctgtcgctgtacgacacgctgatggacgccttcgccgcgcagcagctgtgccgcgtgctgggcggcacgctggcggagctgatcgacctggacgtgcaggccgcggcgttccgtgtggcgcaggaggcgctgctgcagcagccgcggctgttcgcccccctgagctccatcacctaccacatcggcctaaccgacataacggacgaaaacagctggagatggatcagcgtcggcggcaagctgcaactggattcggcgttgtgggcggcgggcgagccgtcaaatgtggccagccccgtcttcagttcagacgccattccgctgagcgatgaggactgcgcggtggcaacacagtcgggcaacaccagccagtgggtggcccggccgtgtcgcttccagttcacccgcccgatgtgccagcgccccacatccgcctcggcctacggcgcgcagctgcggtccctggcgcccgccgcccagacgctgcagggcaccgcccacttccagctcttcacccggctcatggactggcccgctgcagagatgctatgccaggcgcaaggcggcaacctggcctggtttgacagccccctgcagtttgaggcggtcaccgcaatgacgaccagctggatgcgacgcaacgagcaggcatcaaattttggcacgtggttcggcctgaatgatcgggtaaccgaggatgatttccgctattctgccaacccacgcgtccgcgtcaatgccagtgcctggcatccatgggccgcaggctccagaggtcgagactttgtagatctgccggtgtcaggcgctacaaactttggatcgtggtcggcaacggtcacgtgccccaacggcactgtcgtgcgcggtttctctgctcgggtggacaatcgcacagctgctgtgtccacagcgacagacctgatgggtgggcctgtggccaagtgccccggcaactcatccaattacgcagtcgggctgcagcttcgagctgttgcaaagcaggactactcaatatttaaattggttcgaacatccgccaaccgtactgccaccgtaagcatggcgaactccagcgcctcggacaacacaatggtcaacggcgcatatatccggtgctgtagtgacgggccaagcgtcaatgattgcgcggagatcaggaccgaaattcgggatggcagcgcgacgactggtgtggcgaggtgggctgaccaaccatgcacggacgagttcctgctgttcgatgtgcccatgacctggtccctggccaagtccttttgtgcggctcactctgcggaattggcgcccgtcatggacagtatggagcagcagtcagcatccgacctcgttgctagctgggcccgtggccgcgtgggccgctccgtttcattttggtttggagcctccaacaccggcagtgagttcttgaagggcgcgcgcgacggcgcgccgtggcgttacacaaccggcgagcgtctgcgatggagcgcctgggggcgtgattccgtggccccgatccggccggcatgtggcgagatgcgctttggggtggagctggtgcccgtctcgctgtcgtcgctgctatccggctcgcgggtctcgcagtcgctgctgcgtgaggttctcacatcaaacaccaccagcggcatcgcacaaagcggtaccttccaacttcctcgtgtcggccggcggaaacctgggtgggcggccagtaactgcggccagcacctgccagtgctgtgccgccgcccgctgtctcgccgcccgatgccctcgcccggttctccccccagtgtgtccatgactctgcgggagacgcgctctacactgttccggcaagaaatgaactgggaccaagcggagaaattctgcaggcagcggggcggcctgctggcgagcgtgaacacggcctctgaggccgaggcgctgctggccatggtgcgcgagtgggcgcgcaacagccgcgtggcgggcgtcacccgcctgtggctgggctccaagctcaccaccggcaaccagcgcgggcccgcagaaaaccgtgtccgtaactggcaatggctcgacggaacctcgttcgactacgttcgggggcgcaacgatcggcggttcatcaacccgctgctgacgggcccgacctccgaggcgcgctgcctcacatggtcggtgtcagcttctccatctgttgcggccgttgccgccagcaacacagcagggccggggcagctggatgtgcggctgatccagcggcttctggatgcggccgacgctgtggacgagtgggaggccgtgtcatgcagaagcctagccctgccactttgccaagcagacctgcagcctttcatctgcaataagggtgacgcattcacgcgcccagtggactcgggcatcggcgccgacctgtactgtccgccagggactctccttgctggcatcaatggtcacgtgcctgcatccactggcggtggggttttggatcagcggccggtgtccttcgcaggcgtgtgccgcaacccgcgcgcgcccgccattttggcctcccggggtaaggaggaagtgccgctatgccggccgcgctggtcgctgccccgcgaggagggcccctccttcctggtgcaagccgccaaccggcctggcctgctgtccgcctgcgtcgacgcctgccgcctgggctccgtgcgcaccacctcgccctacacctcccctgcgctggcggtgctgtactccaacacctcctccaccctagccacctgccgctgcgcacgtgcgctgaccgggcagatgctcaacctaggccgcaacaccgccatcgccgccatctgcgccgccagcgagacccgcatgcgcaccgccgcgctggaccccgtcagctacaggctgggcctgactgacctgggctggacgccgcggctcacctctctggtgcgcgactccaagtaccgggtgttcaccaagcccaccgactggaacggcgcccagcgcctgtgcacgctgcacggcggccacctggcggtgctggaggacgcgcaagacgtggccgacctgaccgccctgctggcgaccaacctgggcgtggcctcggagctggcggggcaggcggtgtgggtggggctgtacatggcgcaggaccccatcttcaggtgggtggacggcacgcacctgcgctatggcgggctggaggtggtggtggactgggactgggcgcccaccaactgcggctacctgcgcctggagcgagtcaacggcacctggcgcggtagcctcaaggcgggaggctgcgacgccaaccagttcgccttcgtatgcgagaccagcacaattgtggacgacagcctgtctgacatcacccgcggcgaggaacgggtggtgcctgcctccgcgctgggcagtgccgcgttcggctcctggcgcgtgacgctcttccccgcgcactccgtgtcctggtacgacgcacagcgcatctgccgctggatgggccaggacctgatgtggtacttcaactcgggcgaggagtcgtggctgtcgtcctgggtggccgcctccaacctgagcggcaatgccggcaccgggctgtggacggcgctgagtgccgacaccccgccgcgcatgggctggcgcaccaccgctgccgactccaactcgcttgcgctgtcaacttggcagctgccgcgcggcctggacgccgccgcctccattcccgcaggcgacaccaccggagcctgcgggatgctcaagccgctgccgggcggcgggttcgcagtcggcctggcaagctgcggcgccgccattgcaccctttgcctgcaagcgcggccagcagtggaacggtccgccggcctcgcacagggtgcagctgccgccctcgcctccgccgccctctccgccgcctgccggcacgccgaattcgcttttggagtttgtccgcggccgcatgacgtacatgctgtttggagggacagggggccctgcaaccgactgggccacggctgcgggagcttgtgccaagcttggaggccgccttgcggagtttgcaacgtttagcgagtacatggccatctccgatactatccgccaatacgcacaaggccgcacctctttatcatatctgccctactggatgggcctccgccgagaccctgatgaccgccaaatcttccgttacacctcgggcagcctgccctctccgactgcgacggcttggggacggaatgagcctaatgacaacggcaatcgggaaaactgtgttgaaagccgggtgtacctgcgcgaggatgccgggttccgagagtatgcttccagcagcttgtttagcaacataggccttctggacagcagcactgggctcgccattgcgcagcaggttctgattgatttcacgtatgcgagcttgagcgaagctgagaaggagcagtggcggcgacagcgtaacatctggctcgctgtcaccgtgtctggggtccactacaatttgtacgggacgcttctgacgtggaacgaggccaaggcctggtgcgagggcaacggccaaagcgtcctagcagacttcatctcgagctctgaatacttggcggttgcgcgggctgccagtcactgggttcaagcgcaagcggcctatggcgagccggtcatacagatgtggtcgggttataacgcagtttcttacgacacatttgggaacaagcttgtgcttgtggccaacggcagttccgctgcatcccagtactgggttcccagcgagtacatgttttcgggattgcagtcttccccggagtgtgcatccattgtcttcagcacgcaagcacaggccatgtttgccctggctagcaactgcaacgccacgaggatgcggccgttgtgccgctccacccgtgctgcgctttcctcggcgacgccaacagggcctgcggcggggccgctgccggtgcggtcgctgtacgagctgcgccagtcggtgtcgtaccagatcgcccggggcgcctacgtgtacacgctcctgaccgaccccgccctgagggccagcttcatgcaggcccaggccatgtgccagttcatgcctggcgcgcccgggaccctggcgaccatctacacactagaagacctgaacttttttgctgacgttgccgcgcgcgcggagggcgacgcgccgaacgtatgggttggagccggagacttcctgtccccagactcgccgtactggtccatcgccaacctggacgtgaccgcgaacggcctggcgcctggctggctggacgaccctgaccgtgtgggcaacgagaccgccgcctgcgccttcctggacacctccgcccgcccgccccgactgcgccgcgcggcctgcagctcgcgctttgcggtgctgtgcatgtcatccaatgtgcgcggtgcaccccagcatgtggcgctggcggaggtgaccggcgacggcctgcctgatgtggttgtggccaccaactgcccctgggacaacggcgcctcgatcatagcgctgcagcagcccagccccagccaggctgtcctgcaggccgggccggacgccgacaccctcatcacgccctccatgtccgtccgcatgtgcggcgacggaatccccatctggcagcgcgaggaatgcgacatgggcgtggacggcacccgcatctgcgacgagtcctgccgcgtcactccgcgctacgtggtgcacgccagcgctcgcgaggcgttcatcaccgtgggcgacggcgacctcacgctggaccactggggcgtcaactacaacctgtacggccaggtccgcggctttagcgacctgcgcgaggcgcccaccgacccgctgctctaccccggattctttgccaacagcgccgacaacgtgtgtcccgccagccagcccgtgcccgtgcaccgcgtcaagaacctggcggccggctaccccttccagtacagggcgttcctgcgaacggacctgtcaacgcctgcgctgccgacatggacggacgttgagtcggcgtccgcctcggacccctccttcaccaacgccacctcctcctgcggctgcacgcccgacaaccccggcggccagcccgtcaacctcacagtggcgcagcaattccagtccatcgccatcagctgggtggtgggcagcgcctgcgaggcgggcgtgtccgtgacccgcagcctcatcaacccgctcacggggttgccgctcaacaccaccaccgtggcgcagctgtccatcgggctggagtgcagcgcgcagtaccggccctcaaagacggagatcgacgaggacatcgtccgagatgacctgcaggtcggcctgacctatcgctattgtgtggtggtggcatccgccgcctcctcggcctacttcctcaacgcaagcgacccgctgaaccccgaccgcttcgtgtcccagcccgagtgccgcgacgtgacaatccagtgggcaggccggctgaccggcgaggtccgaaccaagtttgacacgcccgcacctggcattcgcctgactgcccgcctgattggcagtccatacgtggtcagcggcattacggacgacagtgggcgctacgagctgacgctgcagaccaacgtgcccaactgcgaccccatcgtcgctccggagacttgcgtcaaccagttgatcaggctgaccgccagctcgcgcaccaagctgcgcagcggccgaatcatcccacaccagttctccatcaacaaccgcctgggggcggcacagacgctggcgctggcacacctgcaagtacaggagggtgtccgtatcctggatgagacgtcacttcccgttgcgggctttgttagatggccgggcacgcccgccaactcgggctacaatcagccacgcggctgtccgatccgcgacgcccaggtgtgcgccgtgaaccaccgtgacaacgtaacgatcagctgcgccacttctgaccctgatggctccttcctggtggtggcgggcatcggggcgtacgtgcggctgaccgccaagtacggcaaccactccttcgccatcaacatgccgggcggcctgccggtcgaggacacgggcgcgtttgagatcatggcgccggtgtatgacgttgacatccggaacacgcagacccgcacgctgcgggtggggctggtgggcgggctgtgccgctacgcgctgggcaagccacagctgcagttcacggcctaccagtgcgaggaccagagcggccagcgaccgctatatcgccgcgttgacttggaccccgcccagccgtacaccgacctcgtccttcctgccctggcctgggaggtgcagtacgtggacgtgaaggaccccatcccagacctcaacacgcaagccgtgtttcagtacctgctcattaccaaccagatctccaaatttgccaacctaagtgcgaacaccgactccgcggcgccgcccacgacgctgacctgggagttcttggcgccgaatgacattgaggtcgacgtgtgccgcaacgtcaagggcaatgctgtgctttgcggcgacatgagcctcacacgccagtgcgctggaaccacatcggcggccgccatcaaggccgtgtacgacgccttccagccgcccgacagcgcgctggtgggcaaggacgtggtgctgctgaggcgaggtgctcagtacaagatgcgaatgcggcttttcggccagtacggcaggctgcggtgcgacaacgtgtcagccagcattttcatgcaggacagcatcagcggggaggtggagaccaacaggtgcagcgtgaagaaccgcgggtgcagcaatgaggtggactatcagaccatcaccaacacctccgagtacatgtacgacctagtgccgctcgccatcaacttcggggcgatgacggcatactcgtcgccgctgtccattgtggcggaaagcaccggctggccctcgcgctccttcctgctctactccatcgtggagggcacggaggaccggctgggcacgggctacatcgaggtgcccatccccgtgccgctgctcattcttcgcgacccaccaggcgaccgctcttacgccacgctggacagctccatctccacagctgtgaagctgtccatggtcaaccacgaccacctcacatgcggcggaccaaacgaaaaagaaatcctgaccaaagcgttgccgctcacggagttaatgcccacagagaaattgaagataggcttcttcagaaagcgcatcaaccgggtcaaggaactcttctccatgagcaacatcaagaggaccatgggtgatgtgctcaagtcctctgagcgcaatctgtttaagctcctgaagggaggctataagtatgcgaccagtgcaaatgacggagccagcgcttacgacagtgataatgaccgtcctgccgaccctgctaagctggagcagggacgaggtggtgcgctcacatggagggagcttggggccgacctgcccagctcagcttctggccagcaagtccaagacaaagtcaaaggggtgattgaagagatcttcaaacaagctgacgctgacgtggacccggagctggtgctggcgggtctcgagcagatgctggacatggatgaggcccgcccggaggagttgatggcgcttctggtgaagagggtggacgagtttggaaaagaaatggcagcgagctctcggtactaccggtcagaagcaccggactttgaactcaacccatcggggctcgacgcaattcagccacagtgcgccaagtcgacgcttgggatcgggtttgacattgacatgggtcaatgcgctgggcttggagtgagcgtgtgcgctccactgctgcgggaccgcggccaggctggcatcgtgactgaaaaggcttggtacaacgatgaggaggaagatagttcctataagcttaccatcacccgcgcggagggcttctccactcccaaggagagcacgccggagctggtgggtggcgacgccgacatgatcctggcgcccaccttcgccatcatgttcacgcttcaggaccggctgcagttcgacaccaagacctgcacacccacagccaccatgggcatccccggctggaacgtgcgcgaggacgcgcatggcactgcctggcacagcgtgtggcacatcaagaacgtggtcgtgccggagctgcagaagcggttggcaggcgagcaggccaaagcggcggcggcgcagaaccccagcgtcatcaacaacctgaaggagggcatggcgggctggcagaacatcctcaaggtctacaacgacctcaatgctcttgcgacggaacgcgaggaggagctgccgtcctaccagctggagcagcaggacgtgaacgggctgactcagggcaccatcgagggcatctggcacaccaccctggacgaccacccggacaggcacatggaggcgtacgagggtcgcaccatcgactgggagcggctggagaagtcgccggtgtggaagcagggctacttcgagggcgcggagaagctgcagagcctgatgctgcgcacccagaggtacatggacgcctcggccacccggggcaacgtggtgttgcggccgcaccagaaggcggcggtgggcggcatcgtggcgggcaagcagctggaccagctgaaccgggtgtacggcaccaacttcaacaccttctccttcagtggcggaggcggcagctacacctacagcctcacctcggccagcacgctcagcaccaagataggcttcagcatcagcttcaaggacatgttcgggttccagggtggcggcggcggaggcacaggattctggatggaatcgtatgatgagaacctgtacggcttcgagctggagttcaacagccagctgctgcaggagacggagcgggagcgggtggtgacggtgcactttgaggacaaggacgtgggggacagcttcctagtcaagatccgtcccgacacggcgtacggcacgcccatgtttgagctgctggcggggcgcagcaagtgcccctacgagcccggcacgctgcagcgcgagctggcgcgtgtgtctgtgctgggcggcctgaacgtgcagcagaacatcaagcagggcgacagcaccgtgtacgagctgctcatcgagaacaggagcggcaccgacgagccggtggcgatgcagctgggccccgacctggccaccaacaacgcaaacatgcagctgcagctcatgggagcaccctggatcgagcccgtgccgtacaagctgcgcggtcccatcgccacccagaccaaggcggttgtgacggcccgctgcggcccgcgctacctaacctccgccgtcgacatcgtgtccacaggcacctgcgacgcagccgagttttcgcgcacgccgctgacgctcaagtgctacagcgtgtgtcccgaggtccgctggccccaggcctggcccctgactgtgcccctgatctacaatgcgaccgatgccctgaacaagaggaacatcacgctgacgctcttcaacccgaactacgccacccagaagtgggccacgcacccgcggctggccacaaacgttaccatgattcaaattgagtacgtgaacacggtcagcagcggcgggctgtggactccagtgcgaagcctcaacgggagcgctgtcaattttgccaagattgaggacgccgcatttgggttcgccacgttccaatggccggcttggcagttcctgaccagcgagggcgactacctgctgcgctacgtggtgtactgcgacatcctggtgggcggcggcatggacagccgctacgagggcagccccatctccctgcacgtggaccgcaccacgccctggcccgtacacaactccctcacgccctacgacatgacctacctgccgggcgacgagatctatgtggactttagtgagcccttggactgccggcagcccttcgccttctggtggctgggcttgcaggccgacggcctcgccaaccgtaccttcagccagcagacaggtgacttcatccccacctgctcgggccggcgcatctcgttctcgtggaaccccttcaaccgccccacgccgctgaccaacggccagaacgtcagcctgcagctgggcggtgtgcgcgacctggcgggcaatgtgcagacgcgcgccgtcaacatcacctttgtcaccggcacactcgcacccaacgcgcccatccgcctcaactttgccatgggcccgctgcccaccaccgtgcgccgcctgctcttcgccaacgggccgggcgccgccggctccagcctgccgcaccagctgccgcaccgcctggcgctgcgcgactacacggaggagtccctcgccgcggagctggcctcgcgcctggccgcgcgccgccgcctgctggcagagctgaacgcgctgctgggcgagtgcctggggccgtggccgcgcggccccgaggcgccgggtgtggtggccagcagcgtggtgcaggacgaggacgtggcgaccatggtggtggagctgcaggcgttcggcatactggagagcgaggaggaggacagggtgggctcgggcgaggacgcgggtctgggcgggccgcgcaaggacgcggtgtgggtggcggagcggctggtggcggcggccgccgacaacacgtcgtgcctggccacgcggctgcagcgggcgtacgcgccggtgcggagcgtgtttgcgcaccgcagccccgagcggcagctgctggacggctggagcagtgaggaggtggcggtggcgcgcaggcgtgcagcagccgaggcgcgggccaagggcctgccgggcgcctggctgggcgcggtgcagtcgctgcaggctgaggcgcaagcagcggcggaggcgcttgcgcaggtggcggagcgggccctgaagagtatgctgggtgagcctgagagcgctgcagcagaccccggcactgtaagcactgacgctgcctcagacaagcaagagccgtatgatggggacaagcagctggtggcggcggctggagcagtggccgccgccgctgtgacgtccgacacgcggcagggcactggcaatgaggagcagcagccgcaagtggcggctgtgtctcgccgcagcatggtcggtacatacggtgtgtgtgtctgcacctggttcagtgctgctgtcgttagacaaaatgggagagcagcagcagcagccttcggcgggtctacgcgctggagctggccgctggacttcacggacatcggtaacaacgcgtctacgctgcaactgtacccgtctacgacttcacttcttaattaa

SEQ ID NO: 202 - DNA, 2172 bp, Chlamydomonas reinhardtii
atggactttcgggaaaaaggcgaactggaccgcactgctaagcgagttgactgctacacggcgcccgccgtgacgcagggcaacagcagtaaggcgaccgtctcgttgtgtcacagccgcaatttggttctggacacgtgcgggttcctggcggcgcgccagcgcggtcagatgagtaagaagttcccgcggccgctgcggggcgcggtgcggctgggcggctgcgagctcgccaacgcaagccgactcgcagagcgggacccgcggctgggatggctgcgcagcatgcagcaggccgtgtggtgggagaacgccacccgggatgacgcgggtgtggcggccgcctgcacgcctgggtctcccaccctggtcaccacgcccacgctgttcgtgctgcgggaccggcacgccaactacgcccacgagatggaggttgtgtccatggccttcagcttcctggcggcgctggagccccgcgacgtggcggagcagggcgtgcaggtggtgattgccgaccaggcgccgcccactggtttcttggagacgtgggcgcgcatgagtcagccacaccggctgcggctgctggcgcaggagcccttcccgcccggaacctgcttcgcctctgcctaccacgtgtacaccttcgccgccggcattggctacaacaccaacccagccacggtcaagtgcgaaagccccgtgctccagggcatgagccactggctgcggcagctgtacgacgaggcggacgcctctgcgcgctccgctccctcccaggcgtccgcggctgcggcggtggctgggccggccactgccgcggcaggcatcaccggcctccgggtgccggctggcggcatcgtggtgaagaacgtggtgtggctcagcaggaggaacctggagatggtgcgcctgctactgaacgccagcgtgggctggaagagcatgcgcatggtgcgcaacgaggacgccgtggtggcgggtctggtggcggcggtgcagcagtggaacgccgagagctgcctgctgcgccgctttgaccgaaacgtggcggcggaggtggagcgatccaaagaccacctgcgccccgtgcacggtggatcagccgccacaaccaccaccgcagcagcagccgccacgaccaccgcaggagcaaggaagcggagaggactgctgggcaaggcctgggcagccctagcgtcagcaggccggcggctgctaggggccgctgccttgggtaacgacctagattcggactcacaaccgcaatcagctgtggattcaggagggcgtcgaatacgacaagccgatccggattttgccggagatgaggaggaggacggggaggaggaggaggaggcggaggaggagggggcggatgtgagcgcgagtcaggacggtggcggggagggggcagaggcagagggcgagtttggcggggccgacggcacggacacggtggcggttggcgccgccgtagccgcctcaaccgtcaaccgcacccgcccgccatacatggtgggcgggaacattatcatgctgagtaagctgtgggcgctggacaagcaggaggaggagcagcagcaacagtcgtcaacagccagaaccgccgcctcaggcggcgccgccaacggtccatgccggccaaccaacgttctgttcaagttcgttgacggcgacttcaacgacgcgccgtacagccagcagctggccaccatcttccgcacaggcgtgttggcgggcgtgcacggcgcaggcctgacccacggcttctttatgcagccggggcagggcgcggtgctgcagctgctgggcgactcgttcgcgcaggtggctgccaacaacgttttccgcaacatggcccggggcctgggccaccactacgaggacgtgccctacagcggcgtggacgtggacgtgccgcagctgcaggcggccgtgaagcgctcgatggactatgtggctcagcaggtgatggaggcgcaggagcggcgcagcggccctctacgcttggtgctcgttgatcagaaccacttcagtgtggtgatgccgccggcagagacttgcccggtgctgacgctacagggcacagcgacagcgacaatgtcggggactggggaagggcaagcgggacccgaagaagggcaggaggttgcgggtgaaggggcgcggtag

SEQ ID NO: 203 - DNA, 879 bp, Chlamydomonas reinhardtii
atgctcggccacaccctcggccagaacggctcgggccaggcgaccatcatcgacatcggctgcaaccggggatacttcaccagcaccgccctcaactattgggcgccggggtttggcaaccacaaccggcttgtgcatgaggtgcaccaggccggggggcagtacggcggtggggcgtgcggcgtgtgcggcgactgcgtgcacggccccgccgcgccggtgacgctgcagccgcaggacgaggtggacgtgcactgcttcgagccctcactgtggcaccagagggcgctgggggcggtacgggcggctctgtacgggccagtggacgcgccaaagacagacaagggcacggcggtgcggtggcacgtcctgccgtacgccgtgtcgaacgccaccggcaccgcgcacttccccaccaactgcacacacgaggagtgcaacttcgacctgaacgagcagaaggctgatgtgaatgtcaccacggtggacgactatatgaagcaggcgcgcatccgctatgtggacgtgctcaagatagacacggagggtttcgatccggcagtcctggcgggcgcctacaacacacttaggcggcaccgagctgaggtgttatctttcgagtaccatggattctggttccgctccggcggcacgctgcggctgtgcctggactacttggaggagctgggctacagctgcttcttcgacgcccccctgctgttcaaactgacggggtgctgggacccgcgcctcgagatcaaagagtggtcgaacatcgtgtgtgcggtgcgcggcagcgagacggaggcggagatgaacgccctcacggcactgaggcagcagcgggcggcgcatcaagcgcacgaggggcggcggtag

SEQ ID NO: 204 - DNA, 1388 bp, Chlamydomonas reinhardtii
atggttttcccagccctggtcgattggttctcgaggccctcaggcaacacgggctgcaccacctgtgggctcttccgaacaaccaatggcacggagatcccggtgccgctcaagcgccgcgacgtgtctgcaaccgtctacgccgatgcttcctttgccgataccacggagaatctccgctacaagagcgatgcggagtgctcagcagtcttccgtttcccgttgccgccgtgtgcagccgtgtacaggttccgcgccgtgtttggagaccgcgaggtggtgaccaaggtcaagccccgcgccgccgcacgcgaagagtacgactttgccgtgtcgcagggccactcggccgtgcacatgtcccagcacgaggcgggtgcgtccgtgtttgaggtgtcgcttggcaacctggcggcgcacaccgaggtgacggtggagttcagctacctccggctgcttgacgcgttcggcggcacgctggagtggagccacaccgccacgtgggtgccgccttacgtgggctcagcgggcgacgtggcgaccggcgtggacaaggtggcggcggcgctgcccacctttgcgcccaaggtgacctacgtcctctcctacgaggtcacggtgcgggcggaggcgggcacggtgcgtgccattgagtcgcccgagcctgtgaccgtggagcgtccgatgccaggcatcaaacgcggcgaggaggagctctggtacgtgcgtctgtcggagcaggtcgccgacccctccaaggacctctcactggcgattgaggtggatcccaaggccgcgcgccgcagcggcctgcgtgtgcagcgcacgcccgcctcccgcggcggcgagcagcgcactgttgcgctggccacatttgtgccaccgctgcccagcccgaccgccgccggcaccgacggcaagcagcagcagctgcgcaaggagatctgtggattcttcggcggcggcagtttagccacctgcatagcggcgcccttcggcgccaatgcggcacccgccttctgcaactttgcggcggcgggcgctgcggcgagcaacgtgccggagctgctgtcgcgtctcaacctgcagcgcaccactgagggctactgggtcgctagcatggagctcgcgaccctcttgggccagacggctgaaagcctggcggcgctgcacccgcgccgtcctgccggcctgaccgacgacgcctgggcgactgtgatcgtgctgggtgtgctgcggcgctgcctggcggctcagcgggaggtgtgggcggacatggaggccaaggcgctggcatggctggcggcggcatggccggagggcggccgcagcgtgggaagcaccgtcatggcgctggcaaaggcgctgacggtgcttcccaaggtgtg

SEQ ID NO: 205 - DNA, 1803 bp, Chlamydomonas reinhardtii
atgctgttgtccgggcgctgcaagcgtggcccgtctcgatgtgttcgcgccggggcctcctctggttcgaatcctctcattcctcggcatggacagccacagctatcaagcatgggaccgtcgcggcaacagcttgcctcagcgccaaatgcggcttttgcagagctcgaagcgctgcccgcagatgaaccagctgctccggctgcggtttccaaatgcccagtcacacaaatgaagagcgcacttagcgcatttgtgcgtgactctggagaccaagttgccgaaaccggagcgccaaccgcaacgcgaccaattcctgggccagcaccgctcagtctggaagcactgaaggacgtgagcgtcatcttcttcgagggcttgcacgtggcacagctcaaattcagcgagaagtacgggcccgtctgccgcttcgccaaccccgcctcgctcaacggcgccaccagctgggtgttcatcaacagcccagagaacatccagcacgtgtgtgcgaccaacgtgcgcaactacagccgccgctacctccccgacatctacacgtatgtgacgcacggcaagggcatcctgggctcgcaggacgagtacaatgcgcggcaccggaggctgtgctcgggccccttccgcaacaagtggcagctgcagcgcttctcatccgtggttgtggagcggtccaagcggctggtcgacatcttcagtgccgccgccgccgccgacccgtccggcgccttcaccaccgacgtggccacccagacgcagcggctgactctggacgtggtggggctggtggcgttcagtcacgactttgcgtgcgtggagcaggtgcagcgggacctggcgggcgccaccgcgggcgacgggcgcagcggcgtgctgcaggaccgcgtgctgtgggccgtcaacacctttggcgaggtgctggcgcaggtcttcatcacgccgctgccgctgctcaaggccatggaccggctgggtgcgccccacctgcggcagctgggcgaggcggtgtccgtcatgcgggcggccatgctggacgtgatcgcggagcggcgtgcctcgctggccgcgggcgggcggggccgtgacgacctgctgcaggcgctgctcacggccacggaggatgacggccggggcctgagcgatgaggagctgtgggaggacgtgcacgacatcatgggggcggggcacgagaccaccgccaccaccaccgccgcgctgctgtactgcatcagcgcccacccgcatgtgcgccagcggctggaggaggagctggatgccgtgctggcggacggcgaggcgcccacctacgagtcgctggagcgcatgccctacctgcaggcctgtgccaaggaggtgatgcgcctgtacccggccatccccgtgttcccgcgcgaggccgcccggcccgacgtgctgcccaccggccacggcgtggcggcgggcgacgtcgtgttcatgagcagctacgcgctggggcgcagcgaggcggtgtgggggccggacgtgctggagtttgacccggacaggttctctcccgagcgcgaggcgcggcagcaccgcttccagtggctgcccttcggcgccgggccgcgcatgtgcctgggcgcgtcgttcgcacagatgtctgtggcgctcatggcggctacgctgctgcagcgcttccgcttcacgccgctggcgccctgctccccgctcatcccggtgggctacgacatcaccatgaacttcggaccctcgggcggcctgcgcatgcgcgtggcgcccaggcagcgcgggcagcagcagtag

SEQ ID NO: 206 - DNA, 2001 bp, Chlamydomonas reinhardtii
atggggtcgggtcgtgacggccggcctgcgagctacaccaagaagaacttctccctggagaagctcaagctcagcagcatgaaggatgacctgaccgttctgcgccatatgtggttcggcagcaagaagggcgatgatcacgctgctcgcctggagagcttctacgggccccaggccgctgcctatgatgctttccggtcgcggttcctctggggtcgcaggcccatgctcgctgcagttgctgcccgcctggccgagcgctcgaacctcatctgggttgacctgggtggtggcactggggagaatgtcgatatgatggctgattacatcgacctggcgaagttcaagtccatctacgtggtcgacctgtgccactcgctgtgcgaggtggccaagaagaaggcgaaggccaagggctggaagaatgtccaggtcgtggaggccgacgcttgccaatttgcgccccctgagggcaccgcgacgctcatcaccttctcctactcgctcacgatgattccaccgttccacaacgtcatcgaccaggcttgctcgtacctgtcccaagacggcctggtgggcgttgccgacttctacgtgagcggcaagtacgacctgcccctgcgccagatgccctggtcgcgccgtttcttctggcgatcgatcttcgacatcgacaacattgacatcggccccgagcgccgcgcctacctggagcagaagctggagcgcgtgtgggagcagaacacccagggttcgatcccctacgtgccgtggctgcgcgccccctactacgtgtggattggccgcctgcccagcgttggccacgccctgcacgaggagcgcgtggagcggccgcccatgttcccgcccaccttcctgtacacgcagtcgtgggaggaccccgagccggatatggaggtgatggagatcaaccccaaggacacggtgctgaccctgactagcggcggctgcaatgccctgaacctgctggtgcagggggccggccaggtggtgtcggtggactgcaaccccgcgcagtcggcgcttctggagctgaagaaggtggccattcagcagctggagtttgaggacgtgtggcagctgttcggcgagggcgtgcacccgcgcattgaggagctgtacgagaagaagctggcgcccttcctgtcgcaaaccagccacaacttctggtccaagcgcctctggtacttccagcacggcctgtactaccagggcggcatgggcaagctgtgctgggtgctgcagtgcctggccgtggtgctgggactgggcaagaccgtcaagcgcctcgccaacgcgcccacaatggaggagcagcgccgtctgtgggacagcaacatgctcatccacttcgtgaagaacgggcccaagccgctggtgtggctgttcgtcaagttcgtgagcctggtgctcttcaacaaggccgtgctgtggttcggcggcggcgtgccgggcaagcagtacgcgctgatcaaggcggacggcatccccattgagaactacatcgcgcgcaccatggacggcgtggcggagaactcgcacgtgcgcaagcagaactacttctactacaactgcctcaccggcaagttcctgcgcgacaactgccccacctacctgcgcgaggcggccttcgccaccctcaagagtggcgtggtggacaacctgaccgtctccaccaacttcttcatggaggagctcaaagcgcgcacctacaccaaggtgattctgatggaccacgtggactggctggatatgcccgtggccaacgagctggccgagtgcctggccaagcaggttgcgccgggcggcatcgtcatctggcgctccgcctccctcagcccgccctacgccgagctgatccagaaggcgggcttcgacgtgcgctgcatccgccgcgccactcagggctacatggaccgcgtcaacatgtacagctccttctacatggcccgccggaagggcgccaagaaggacaactaa

SEQ ID NO: 207 - DNA, 127 bp, Artificial Sequence
  amiRNA cloning fragment
gatctgagatctacggtaagctgttagtgattatctcgctgatcggcaccatgggggtggtggtgatcagcgctataatgactaacagcttaccgtagatcttcgtgccgcccggctgcggaggtgg

SEQ ID NO: 208 - DNA, 127 bp, Artificial Sequence
  amiRNA cloning fragment
gatctgagatctctgaatctggcttattctatatctcgctgatcggcaccatgggggtggtggtgatcagcgctatatacaataagccagattcagagatcttcgtgccgcccggctgcggaggtgg

SEQ ID NO: 209 - DNA, 127 bp, Artificial Sequence
  amiRNA cloning fragment
gatctgagatctatgcagtaccgatgtttcaaatctcgctgatcggcaccatgggggtggtggtgatcagcgctatttgtaacatcggtactgcatagatcttcgtgccgcccggctgcggaggtgg

SEQ ID NO: 210 - DNA, 127 bp, Artificial Sequence
  amiRNA cloning fragment
gatctgagatctgtgagaatgcaatgtggaacatctcgctgatcggcaccatgggggtggtggtgatcagcgctatgttttacattgcattctcacagatcttcgtgccgcccggctgcggaggtgg

SEQ ID NO: 211 - DNA, 127 bp, Artificial Sequence
  amiRNA cloning fragment
gatctgagatctctggattcgatcaactagttatctcgctgatcggcaccatgggggtggtggtgatcagcgctataacaagttgatcgaatccagagatcttcgtgccgcccggctgcggaggtgg

SEQ ID NO: 212 - DNA, 127 bp, Artificial Sequence
  amiRNA cloning fragment
gatctgagatctcggcaattccgatttgagtaatctcgctgatcggcaccatgggggtggtggtgatcagcgctattacacaaatcggaattgccgagatcttcgtgccgcccggctgcggaggtgg

SEQ ID NO: 213 - DNA, 127 bp, Artificial Sequence
  amiRNA cloning fragment
gatctgagatctgagtggtttgtgttcttctaatctcgctgatcggcaccatgggggtggtggtgatcagcgctattagtagaacacaaaccactcagatcttcgtgccgcccggctgcggaggtgg

SEQ ID NO: 214 - DNA, 127 bp, Artificial Sequence
  amiRNA cloning fragment
gatctgagatcttcgggaccatagtgttacatatctcgctgatcggcaccatgggggtggtggtgatcagcgctatatgaaacactatggtcccgaagatcttcgtgccgcccggctgcggaggtgg

SEQ ID NO: 215 - DNA, 127 bp, Artificial Sequence
  amiRNA cloning fragment
gatctgagatctgtgggacaggcacaacaaacatctcgctgatcggcaccatgggggtggtggtgatcagcgctatgttagttgtgcctgtcccacagatcttcgtgccgcccggctgcggaggtgg

SEQ ID NO: 216 - DNA, 127 bp, Artificial Sequence
  amiRNA cloning fragment
gatctgagatcttagatgcggtgaacatattcatctcgctgatcggcaccatgggggtggtggtgatcagcgctatgaaaatgttcaccgcatctaagatcttcgtgccgcccggctgcggaggtgg

SEQ ID NO: 217 - DNA, 127 bp, Artificial Sequence
  amiRNA cloning fragment
gatctgagatctgtgcagcatgtctcctatgcatctcgctgatcggcaccatgggggtggtggtgatcagcgctatgcaaaggagacatgctgcacagatcttcgtgccgcccggctgcggaggtgg

SEQ ID NO: 218 - DNA, 127 bp, Artificial Sequence
  amiRNA cloning fragment
gatctgagatctctggatgacgattccttcatatctcgctgatcggcaccatgggggtggtggtgatcagcgctatatgtaggaatcgtcatccagagatcttcgtgccgcccggctgcggaggtgg

SEQ ID NO: 219 - DNA, 127 bp, Artificial Sequence
  amiRNA cloning fragment
gatctgagatctcagatcattgtggaccaatgatctcgctgatcggcaccatgggggtggtggtgatcagcgctatcataggtccacaatgatctgagatcttcgtgccgcccggctgcggaggtgg

SEQ ID NO: 220 - DNA, 127 bp, Artificial Sequence
  amiRNA cloning fragment
gatctgagatctatgcgttgtttgatctgcaaatctcgctgatcggcaccatgggggtggtggtgatcagcgctatttgtggatcaaacaacgcatagatcttcgtgccgcccggctgcggaggtgg

SEQ ID NO: 221 - DNA, 127 bp, Artificial Sequence
  amiRNA cloning fragment
gatctgagatctttgcgctccacatttaaaatatctcgctgatcggcaccatgggggtggtggtgatcagcgctatattataaatgtggagcgcaaagatcttcgtgccgcccggctgcggaggtgg

SEQ ID NO: 222 - DNA, 127 bp, Artificial Sequence
  amiRNA cloning fragment
gatctgagatctctggctttcctgaaccacaaatctcgctgatcggcaccatgggggtggtggtgatcagcgctatttgaggttcaggaaagccagagatcttcgtgccgcccggctgcggaggtgg

SEQ ID NO: 223 - DNA, 127 bp, Artificial Sequence
  amiRNA cloning fragment
gatctgagatcttagcctcgatttgcagattcatctcgctgatcggcaccatgggggtggtggtgatcagcgctatgaaactgcaaatcgaggctaagatcttcgtgccgcccggctgcggaggtgg

SEQ ID NO: 224 - DNA, 127 bp, Artificial Sequence
  amiRNA cloning fragment
gatctgagatctttgggtaacgacctagtttcatctcgctgatcggcaccatgggggtggtggtgatcagcgctatgaatctaggtcgttacccaaagatcttcgtgccgcccggctgcggaggtgg

SEQ ID NO: 225 - DNA, 127 bp, Artificial Sequence
  amiRNA cloning fragment
gatctgagatctgaggtgttatctttcgtgtaatctcgctgatcggcaccatgggggtggtggtgatcagcgctattactcgaaagataacacctcagatcttcgtgccgcccggctgcggaggtgg

SEQ ID NO: 226 - DNA, 127 bp, Artificial Sequence
  amiRNA cloning fragment
gatctgagatctcagcatgcaggatattgattatctcgctgatcggcaccatgggggtggtggtgatcagcgctataatgaatatcctgcatgctgagatcttcgtgccgcccggctgcggaggtgg

SEQ ID NO: 227 - DNA, 127 bp, Artificial Sequence
  amiRNA cloning fragment
gatctgagatctccgcgaccaattttagtttcatctcgctgatcggcaccatgggggtggtggtgatcagcgctatgaatctaaaattggtcgcggagatcttcgtgccgcccggctgcggaggtgg

SEQ ID NO: 228 - DNA, 714 bp, Artificial Sequence
  cloning fragment
atggtcgagtcgtgccgcccggctgcggaggtggagtcggtggccgtggagaagcgccagacgattcagccgggcaccggctacaacaacggctatttctactcctactggaacgacggccacggtggcgtcacctacaccaacggccccgggggtcagttcagcgtgaactggtcgaactccggcaacttcgtgggtggcaagggttggcagcccggcacgaagaacaaggtgatcaacttcagcggcagctacaaccctaacggcaacagctacctgtccgtgtacggttggtcccgcaaccctctcatcgagtactacatcgtggagaacttcggcacctacaatccgagcaccggcgcgacaaagctgggcgaggtcacctcggacggcagcgtgtacgacatctaccgcacacagcgcgtcaaccagccctcgatcatcggcacggcaacgttctaccagtattggtccgtgcggcggaatcaccgcagctccggttcggtgaatacggccaaccatttcaacgcttgggcccagcagggcctgacgctgggcacaatggactaccagatcgtggcggtggagggttacttcagctcgggctcggccagcatcactgtgagcaccggtgactacaaggacgacgacgacaagtccggcgagaacctgtactttcaggggcacaaccaccgccataagcacaccggttaa

SEQ ID NO: 229 - DNA, 18 bp, Artificial Sequence
  cloning fragment
cgcagccgggcggcacga

SEQ ID NO: 230 - DNA, 1546 bp, Chlamydomonas reinhardtii
atggctgaagcctttgaagaatggcttgataagcatggaggaaaaaagcacgcgagtttagacctggtgaaggaacttccgaacggcgaccgtggcgtagtggcgaccgcgccaattgctgagggcgaacttctgcttctgttgcccatcaactgcgcgctgtacatgccaaacgatgaggagtgggccaagcgtggcagttccttcccggaggcggtgggctacctgcatgagcaccaccgcaccctgagccccttcctggccaccacgcttgcgctgatgtccgaggtggcgcgcggcggcgagtcggcctgggctgcgtatgtgggcacgctgccgccgtcgtgccccgactgcctgctcaactggagcaaggaggagaagaaggacctggagggtacggcgctggaggagctgggccccgaccccgccgccgacgccttcaagcgccacgtggcgccgatcctggccgcccgccgtgacctgtggccgctgcagcagcagggcgagggcgagggcggggcggctgctgacgaggcggctgccgacctggcgctgtttgtgcgggtggcgggtctggtgcagagccgcgccttccacctggaggcggagaactgggtgtcgggagccaaggagatctccaagctggagggcggcggcacgcaggtgttcctgctacccggcatcgacatgatcaaccactcccacaaccccgcccgccgcaacgcgcacctgcagcggctgaacgtggcgcaggcggcggctgccaagctgacggagggcggcgcgccggagggcgtggaggcgttcttcgtgatgcgggcggacaagcccatcgcagagggcgaggaggtgctccacacgtacggcaacctgtcggacgcgcagctgctgcagacgtacggcttcctggattcagaggacggcttcgcgcagcttccgggcggggctgcctccggatccggatcccaaccgcctgaagcggctgcggaggaggagggcggcaacggcgggaagaagggtggcaagaagcgcggcaaggccggggcgtctgccgccaaggggaaagaggaggcggaggagggggcaggctaccgcaacccctacaatgcggctctggtgccgtgggaggcggtggaggacgtgtgctgcggcctcatgaagtccatggaccagggcctgcccgccgctctgaagcgcgccaagcgggagttcctggctgctgccggcgtgctgcagctgtctctggggacggcgctgctggaggaggatgaggactttgcggagatggtgtgcatcgccacgttgcaggtgctcaagtcttgtgtggagcgctacccctccaccagcaaggaggacgtgcggctgctcaagagcagcgagtgcaccggccggcagcgcctggcggtgcgggtgcggctgggcgagaaggatgtgctgcagctggcgcaaaaggcggtggtcggctacggcgcggacgagttcgatgacggcattggtgaggcgcacgaccgcggcaaggcgcacgaggcacccaaggccagcg

SEQ ID NO: 231 - DNA, 22870 bp, Chlamydomonas reinhardtii
aggaccctcagtctgccttcctcacgtgccaaggccgtatttaaggcctggaatgagtacacacggggtggcccttgggggaacggcaagcccgcgtctgctgaggagatcctggcatacctcaactccgtggacccgcccatcaccatgaccaacctacgttgccggggtgatgagaacagcgtcactcagtgcgagcgcgacgtgaccaacctcggacgctgcactcgggctcagtcggtcggagtgcaatgctttgaagacgactacaccgtccgcctggtcaacaacgccagccaccccttcctggccaacggcctgaagcagggccgagttcaggcctggctgggaaccgggtggggctacgtgtcaagctctggcttcacgaacgaggatgcgcaggtggtgtgtaggcagctcaagctgcctactgttggagcctatgtatttggcaacgtggagccgttcgtcggcaaccctggacgtctgatcctgcccggcctcaagtgcactggcacagagtcattcctgggtgactgccccgtggacaagacgaccgcgacaccaacccaggagcccgccttcatcttctgccaagagcccacgttcgctgtacgactcgccggcggcgcgcacccgtctgagggccgtttggaggtgcactctcagtcagccacttgggagactgtgtgctgggcatcattcgacgcctcagctgtggacgtggtgtgccgacaggctggctttgagaccacgccgctcaacccgccttcctacatgaatttttccacctcgggcatccccgatgcgcgacccaactacggcatcacaaccattatgaactgcccgccaggagccagttccatcactcagtgcggcaacttcaccaatgactttgaaaggaaatggaccctcccgtccagctgcgccagccctggtctggatgtggtggtcaagtgctaccagcgcccaccgctgcgaacagatgtcgtctctcgctcattgtgtacggacccctggagcactcagtctcccatctctcccgaagctggagtaaccgccatgctggttggagagtttgatgaccaagttgtgggcgatcgctcgcaggatgtcctgctcctcaagtacggtgcggacggcaagctcatcggtcacgctgcattcggccgcccctgggggtccaccttctcagcagaggctgattacgacttcggcccgacgcccaagcccgacgtcctcctgcttgccgacatgaccgggagcggccgcgactcgttggtcgccgtcacgtccactcaggttaaggtggccattgccagcggctcgcgcggcttctcgccgctcaccacctggctggacctaactggctcgcccttctccatcgatgtcaccaacaccacaacccgctcctatgttttcacggacgtgacgggagaccgtgcctccgacatggtgtttttcgatcagcccaccttgcgcctagcgtacatgccaagcaaccggaacaacaagctggtggacgacaccgacggcgacggtaccacttggttcgagctctccacggtatggaccgccgggcggcagcagcacgtgtcgggacgctgcgcctcactcggcgaggactgcttcctgatcacatcagatgtcaacaacgacaagctgaacgacatcgcgctggtgtatctggaccgtgtgactgagacggaggagttctacctgaccctggtcaccacaagcccgcccgcacccctcaactggtacatgacctccgccgctgtgttccctcgcggcgcctgcacctcgccgcaagccgtggccctgggacagtttgtgggcctggacggctcgttggacggcaccattgccggcaccaaccagccgcagctgctgtgcctgtccagctacgaccagcgcatctacgtgggcgggctgggcgtgtggggttcgctgcccgggcctgtgacgtcgctgcatgtgcgggatgtggacgtggacggccgcgacgacctgctcatattcaccgaggtcggctcctactacctcgtgtccaccggtgcttccttcgggccggcgctgccgaccgccgcatggctcagcccctcgtctgtcagtctcgcggtgccgctaacgctcgacctgggtcagaccgaccagaccgcgtccagcgttgtagcctctgccgacgtcattggtgccgcacccgtggagcaccgctgcggcccgccgcgtcgcgtggttgcctattacaccaaccgccgccccgacaagtcgcccgcttgcctggcctcggtcgcggatgtagagaccactgcacttcagcgcgccgctgcagccacgcacgtcatcttcgcgcacgtcaagcccaacgccgagaccatcagcgtcgacctggccaacgagcgcgacgggcccgtgctcgccaacctggacggcaacctgttcaacgtgaaccccgacatccgcgtgctggtgtcggtgggcggacccggaggcctggactctgactactcccgcctggtcctgaacgagcagtcggtggtgggcttcgctaacgccaccgtcacgttcctcaacgcctacaacctggacggggccgagctcagctggcccaacttgcagtcggagcaggtcgagggctacacagccctgctcgagatcctgagcgccaccctgcgccctgccggcaagctgctgtctctcgcggtgccgccgcgcgaggtgtacgtgagcatggactggggccgcctgggcttgctggtcgacatgatcaacttccagggttttgacctggagggtgacgaggtgctgggcgcctcgccctacgtggagacccccctgtttgactgccaggaggcggagggcctgtccgtcaactcgctggtggacttgatcctggccgccggcgcgccaccgcaactgctgactgtggtggcgtcatccatgggccgctctttcgtgctggacggcgatggcttttcgccccccgcgcaacccgtcgcctcaggccccggcagccccggcccttgcatgggcgtggaggggctcctggaccagtccgagattaagctgctgctgccgcccggcgcggcccgccacgacccggaggccttcgcaaacgtgggccccttcgccgccaaccagtacgcgcactgggaggacgcctactccattgtgaacaaggtctgcttcgcccgctcgcactgcctgggcggcgtgggtctgtgggacgtggacggcgacagctacggcgagctgctgggcgctgtcggccgcgcggtgctgggcgacccggccatctgcaccgagtactcgccgcccgagtgcaccaacacggtgtccacccgcggcagtgaggatctgggctcgcccgaactggtggccacactgggcgactcagagttcctgttgtaccaggtccgcaagaactggcccgacgcccgtgaccattgccagcaaattggtggcgacctggtgtctgtgacgtcccgtggcgaggcgggtgtggtgtacagcctcatcaccgcgtgggccagcagcgggcagttgggacccgacgacatctacagcggccgtgacgtgtacgtttggctgggcggtagcgacgcggcccaggagggccgcttcgtgtgggcggaatccggcgccgacttcacgttcacatcctgggcgggcgggcagcccgacggccggtttggtggagaggactgcgttgcaaccaccgtgcggctggccggcagcagcggcgcgggcctgcgccaggtcatcagcagcgaggcgctgtggaacgacgtcggctgcactgcggcgctgccctttgtgtgccagcctctcgggtcgccagggctgctggcaggtggtgtcgggaactgcggcgacacggccctggcccgctctctgctgcgcgcggccaaggaggtgccatggctgtccgcgacctaccacgtgctggcgcccgcggaggagggcgaccccggcctgatgctcacgcagcccgaggccaacaagctgtgccgcagcctgggcggagagctgcccacgctgacggacccctgggtgcgcgaggacttgaccagccagtaccaccgcgacctgcccacgcacacctggctggggctgcgctcgtacggcgatggccagctgttctggaatgacggcactttcacgactgacggcatgctgaacgcctgggagcccggcgagttcggcgacgcggcctgcggtctgatcgtaggcccgagcggcgccaacgtaacagtctcggccggaacgctctacagcttctggaacgccaccaccttccagggcgccatccgggacctgacgatttacaatctcacagactacttcgcgccgcaagtgcagatgtacagcgtgtttctgcctcagggcgtgtactcgctcagctgcaacgagcgcatgcccaccacctgccagacgggcatgcccgcggtgtccttgacgcccaacttctactgcctcacgcgccccaacggccgcgcctatgtggtgcccggcaaggagctgcccagcatgcccctctacctcagcaccgagcgcgcctgcgccgccgcctgcatgctcaacttccggtgtgtgtattacacgtggctgccccgcttccgcgcgtccttcctccccaccgacgaggtcctgggccgccccaaccagctgcaggaccagggctcctgctacctgatgggccgcccctggatgcccaactccgaccgcctgcccaagctgctgtccgagatcaccgacagcgaccgggtgtgcttccgcagtggcagcatcttcagtggcgacaccctgcccatcagcgacgacacgctcatccagccccccgccgccgtcgggccccttttcggcaaccccgcggccgtggccgctaaccccgcagggacgccacctgccacgcccttttctctgctgtgcggtagcgacggcgccgctgcaccgctgcttagctccctcaccttcctcgtcgacaacggcacccgtggaatccaggacgtgggcgcagcatgcgccggcaccgtctccgcgggtgtgcttggctccgtttccgccgagggctacgagctgcgggtgcggcagttgcagcggcctgtcatccagtcgtacaccgcgcgctgcggccccggcggagtgacgggcatgttgggcagctacgacaaccgcggcatgtgccaggtgtctctgacgtgcgccagtggtgccgttgagccggtgctgcctcccacggccagccgcaactgcaccgccgcggcctccttctttgattacgagtgcccgcccggccagctcgcgattgggctgcagggcttgttcctcaacgctgccacttatacggcctccgacaacatactggccgcgattcggatgctgtgcgccgctgtgccggtcgcaatggcggcagctactggggccttctttcaggagctgatgcagtcccggcgcgtggaccttggcatcaacggcggtggcagcgccaggcgccggctgcaacagacctcgccgccgtcgcccacctgcgcccaagccgccgtcgcctgtgccgtttccgccccgtgcctccccgccattcccaccatcgccgcccccggttccttcaccgccgaatcctccgccgtcgccagcaccccagatccccacccctccatcaccaccgccaagacgtcatcctctgccgcgactgctcgcccctgtttgcgccatatcatcacgcagctacaaacgccgatcgtttcggcgggggctctgccgctgcagtctggcgccgtggcgaaccaaccactgacggggctgggcggcgtgtgcgcacctttagcatcggcaccgggtgcggtcgacaccgtcagcgcaggcctgccagcggtgccaacgttgcctcccatctctgggcagccctttaatgtgtcgattgtgggtggtgcggcatgccccaccggaattgtgcaagtgaccggcctgcacctctcattccgcattggccctcccgccaacccgtcgtacgtcaacaacctcgctgtcagatgccgtaccgtggccacgcctctgcccctgccgaccgcgcccgtgggttaccctagccaccggccattcagctacacgtgcccgccgagcaccgtgctgtcggagatcttttggaatactcaggagtggccagcttcgtcgccaggcaccgtccgcaaccagcccgtcccggtcatcaccagcctcgtcttcaagtgcaccccgtggacggtgccgacgcctgccgcccccatacccccgccatcgcccttcagccagattgaggcgaacagcatgaccagccttaccctggcatgccctcttggccagtttctcacttccgtttacggcaggttcgactcggcgcccgccaacatgggtggcgtggcctttgtgcgcagcctgagcatcacatgcagcggccccaccaccgtcacgcgcgaggtctcaaccatcatggccccgaccgccgccaccacgcccttcacgtccgcggtgtgccctggcggcattggcgcgctcacggctcgcacgctggccgtacctggagcccccaccaccacgcctccggcgctgctttcgcttgatgcgcattgctacgacacgcaactgcacacacgcaagctgagcttcctgccacccgcgctatcaaacgcagcaccacaagtggctgaccgtatctcggagctcacagaccgctgtctgggcctgaccctggtgtcgggtattacggtgttgcgatcaatgtttagcggcggcgtactcatcacatctggcgttcccacctcctccttcctgcacggcattaaagtcagctgcttcgacgtgccggagcctaatccaccggcgttggccgtgtcggcccaactgccgcccaaccagctgccagccgcacccgcggtcacgttcaagtacgaatgtccggccggctccaaggtcgtctcagtgctgtcgcgcgtggacgcagacgatgaccttctcaacgtccgcattgaatgcgacaacgcgccgcttggcgacgccgagtccctggcgtccatagcagcccgcctcacgccattctttgcgccgcctcagatcttcgttgccaactgcaccaactgcacaactgccgccaacgtcagctcgatgggctacggccagcgacgctacatcagccctgacattgccatctcagcgccccgcacgtcgtatgtcatcgagcgcacgtgccccctgggcatagccggcatcatcaacaccgctacctcgagccgcatcgtgccggagcttggcggcgctgccacgcccgtgtcgtccgctgccctgcccagcagcgtggtgactggcgccaccattgcgctgttcgacgtgctgttggactggggcaacgccgtcgctttctgcatggcccaagatggcgcgctcatgaccattgaggatgagttgcagcgcctggcggtcggctcagtggttcaggagtgggcggcggagaacaccggtgacgcggtactgggtgtctggattggcgcgcgccgcactggtaatggcctgtacgatttcacgtaccaagataacacccctatgggtggctacgtcgcgccctgggcgcctggcgagcccaacgatctgtcgggcgtggaggattgcgtggagctggtcgtcaacgtgaccagtgggcttgtaagctggaacgaccgcgtgtgcaccggcttagtgcgccggccactctgcaagctgctgcctaaggccacggtggagggtgcgaactcagctgacgtggcgccgccgaatgtgcaaatctctgctaccaacaatgacgagctcagcttctacaacgttagcctgacgtggtatgagggactcaacttctgccagcggcgtggcggcaacctcgccagcttccgcgaccaggacgagattaaacgattcagcgcagcgatcacggattggattggctacgctgaaccagggcggttcttataccagtacacaacgcttcccatagcgtggacgggtctgcgacgccaaatgccagctgcgggcacaccggccgaggcgctgcgctccgcatccgctgtgtttcagtatggcggccgagagttcctcttcattcccacgctggccactcctgatgaggctgacagcgcctgccagggcttcggaggcaatctagccaccctgtatacgctcgatgaatacaacgccgtcctcacggagttcctgcctgccatcattcgatacggcatcaactcgacagcttcggtggttgcaacccacatcggcctcatccgcacaaacttcagcagctacggctggcgtgatggcctgggttggaacggatacacgcccgtgggcgtgcctgtgaacatggcgtcactgtgcggcgtcatcaacactcgttgcgccgctggcaacacctcagtaagcttctcatcctgcagctggaacgtcagcaccaccagctgctcgttccaggccaacagcatctacccagctcgcaacccctacatctgcagccggctcactcccgcgacatcaagcatcgtctccggctaccggcagtatctggcctttgctgagcggcgcacatgggccggcgcggccgcgggctgcgcagccattggtgcccgcttggcgagtttccagctgccagaagactacagcgcgttcctggcagtcgccaacaggtctcaagttttcctagctgctacgggcatgaccacgtcgctcgccggctccgcccacattggcctgtcacacgatagcaccggcgcctacagctggtccgacgggcggcccctgctgtatggtgtgtgggctgcgggccagcctgatgccctggccgccaacaccacctgcggctccttcgcgctgtcttgcacaaactcctccggcgtctggatgaactgtgcaacgccgcagctacgggacgtggcatgtggcacccttgcgccctacgtttgcagctacgacttcgacgacgagtgggctttctcagatggaacgcctctgttgtacacacgcgccacgccagctgccctggggcagccggccgctatcatggccggcaattaccagtgggaccagtttaaccggacaggtcatcgccccgccctgccctcttgcatatggccttggctatgtgccagagggatgggcgtgcaatatggccgggtgttttcgccagctgtcgggcgacagactgacagatgggtgcgtcgcctgcggggcaggggtcgcgccggccgtgcgggcctaagcggccaagctagcgagctgcccattcgttctcatagctgtcatagtaagctccaacatgagcagaacgcgtcggtagtctcgctgggctgcacaggcgcaaccgcgagccgcgactacacgggcacacccttcctgactttctccaccaacgacaccgagaagtgctgcagcacctgcagcgccaccccgggatgcggctggttcacaattgtcaccaacaccagcacctgcaccctcaagcgagccaacggagtgcttgtggcctcagccaaccccaacatgcggtccggagcatccggccgtccccttgccagcctggccgatcctggcgcccttctgaaccctctgggcagccctgactgtgtcaccttgacctctggtttggatcagcggctcttgataggaagtggcgaaccaagcacagttggatcagtttaccgaatgccgaaccagcagtgtttgcagaagtttccagtggcatgtcgacgctcaaacgcgaaggaggcagtgcccgaaaccgagcgccgcagtttggcatcatacatccagcccgtcggcagggtttacaccagtaacggccagctggagctgtcactttacaagacatggcaggactctccatctgctcagaagttctgcgagctgcgcggtggcaccttagtggagccgacaacctatcagatccaagaggccgccttccgcttgggtttggatattctttaccgtggccagtcaacggtcttcgtcgactaccacattggcgcgtcggacaagcaacatgtcgccgaaccagacgtgggctcctaccttttgccggtttgcgggctcttatcccatgtgccaacgttcttcccgcgcctgatggattggtaccaagccaaggccttttgcgaggccaactcgggagacttggcttactttgacagcgcccagcagtatgaggaggtggcatcatccctacggcaatgggcacagacccgcccgttcgcatctggcagcatttccaggagccagtcctacgtcagcgtgtggttggggctcaacaatcgctttggttcgtggcggtggtctgcaagaccctacgttgatgtgaacccggtttgggccccttggaccggttacaacgccaccggtttcagggtacgcaaccgagcctacgatgccccggcgatgggtctcatgtcgcccggtatcgacacgccgttcaccatgtgccccaacgagacggatgcggagagtttcgttgtgggcttccgggcccaagtcgacacccggtctttgagtgggacgccaactagtgccagtaacttgctaggattgatgggactgcggatgcgatgccgctccaagtcatttgtcggcaccttcgagaacttgatgccggagcaggacatcagcagcattacaagtgtctccggcgttggtgcatggggcacatccgagaccctgtgcaacaattggaacaactcaggcttcggtaactgggtcgtcgggctccagttgcaagcagttccaaggagggatcgacccatcatgtcacaggtccgaaactgcattccgtctggcggcaacccatgcgcatcatacaccgtcagctggcaggcgaccagaacgacgtggggagatgatgtgggcattacgtccatccgtggtatctgcgcaaatcagcgtgcggacaacgccagctgggcccagatcgtcaacccggcgccggcgaccgacgcacagtggcttccgccaatcacctgcgagtcaggctttgctgtctgtggcataagcacacgcgtcgacttttccggtgccaatttcacgatcgccaatgccagcaacagtgcaagcgacgactctggagtttctggagtcacacttcgctgctgcccacttcgagatcaattcgcgctgtccactgaatgcgcggaagcttacgtgttcgggaacaacggcaccagcgcatggcagcagcggcagtgcgccacgcgtcgatcgctggtcagcataagcaacgtgctgtgccgccgcgagctgcccgatagcaacgccaacgcggcaatgattgtgacaaacacgtccgccaccacccgcgcggccgacaaggagctagcgtccatccccaccctcagctcccccctgctaccggcagtggctcagagcgtggagccgctgggggcagagcgtgtgctgaccaccataacgtcgcggcggggaaccacagaccaggtccagctgtatgaagtcctactctttgacatccccatgccctggcaaccggctgtatcgttctgccaggcgcacggcgcagagcttctggtcattgacgacgacagtaccgcagcggcggcgaaccgcctagtggcgcgtgttatgcctgcaactgccttccaatcttctaccacgttttcccttcaattctggtggggggcggagtcctgtggcgctcatcttctggtactgtgccgccgtcgtagtggcgacggcggcggcgttgcccgtgccacgccatctatgtctacggcacccgcggcttcgcttacgatccgagatgtgcgcaccacgttgtaccgcgagaccatgacctggagtcaggccgtggactactgccagcgtcgatccggcatccttgccagcatcaactccgccaacgaggccgacgtcatcgcggcgatggtacgtgagtgggcgcgaactacgactgctggagaggtcaaggtttggctgggcggctcatggagccaaagcgagaagatgtacaagtgggaggacgagatgccgtttgattacgttcgcggcggcggcttgctggcggcgccggaaggcccaacccagctctgcttgtcttggcggctgctgccggacgggacggacgtgtggcagacggacgagtgcgccgagtttgcgctggcgctctgccagtccgagctgcagcccttcatctgcaacaccggtgccaactcaacgcggcccgtggacgccaacccctatgacgccaaggcaaaggtttattgcccgccaggtacggttctcacgggcctttccggcagcatcgcaaactcaagcctgtcaggggcaagtctggcgctcgccgacggtatctcgttttctggcatctgtggcaaccctgcggcgcccgccatcctggcgaagcgcgacaatgaggagctgccgcagtgccgttatcgctggtcactgccccgcatcgaggggcccgaggtgaccatcaacacagccaactccacaaccgcactcgacagctgctttaagatgtgcgcagtgggcgatgccccgcttgcctacatctaccgcacgccactgcttgcggttctgtaccaaatcaatggcgtcttctcgtgccgctgcggccgggccctggtcggccgccagttgatcaacgatgatgcaatcaaggcggcggaggctaccggcgccgcaacctttctgtacggccgctcgtacgaagtgtatgccatctgcaccgtttcggaggagttcatgaccgccggttactttcagcagatcaccttcgctttgacattgcaagacattactgcgcagccgcccaagctgacctccttggtgcgcggctccaagtaccgtgtgttcagcggccagcgcactgattggaatgcggcccagcgcatctgcactctgcacggaggccatcttgcgacgctagagagcattggcgacatcgacgatctcaaccagttgttgcgcgctaaccttaacattaccgtcgagttccctcaaggcactggcatttggttgggattgtacgcggcacaaaccggatcataccgatggatcgatggtacacccttgcgctacccgctgggacccgtgcttgaggactggggctatgcaccgccgaattgcggatactttgacccgtggctcaattccaatcgcggcggccgactaatcaacgccgacgtgcgcgcgggatcatgtgataacgccaacgcctttgtttgcgagacaaacatcacgcccgggatccgggcctcctacactccttcgaccgcgactaggggcgccgcctgggaccttgtgcagttcaaggcgcaccgcgtctcttggcacgacgcctcacgcatttgccgctataataacatggacttgatgtggttcacggattaccttgaggagagcatcgtgctcagtacgggcacagcatggctcgctgccacgccggatgtgaccggccgcatatcctggcgcacccgcgcggagtccgctgctgccctgcgtgactcgcggtggaccctgcccctcaactggaacggcacagccgcacagctcctcgcccgaaccgattacacgcagctctgcggcatattcgacgcaactatttttgtgagccctaacccaagcacacgccaaagcccgttttcgctggcgcactgcaccaatgaggcgtaccccttcgtatgcaagagtaaagtcgagcgatggcgcggccttcccgctacaaacctcgtcacgccttcgccccctccacccccaacgccaccttcgccaccacctggcattggtaacgtgctcctgcgcattgagcgaccagcagccacgtttgtcgtgctagatcaggtcacttcccgggccgaggcgtcacgtatatgccgcgccaatggtggtaaactgcctgagtttacggatctgagcgagtatgacattgtcaccgaatctgtacgtcgctactcgaccggcaagacatcagaggcattctgggagttctggtttggtgcatcgagggactacttgactgtccccaacaccactgtctggcgctatgaatcaggcgaaatagcgtcacccaccgtatggggtcctgacgagccaaacaatgttggtgggaacgaaaactgcgtgcatatcttagtgtggctccaggacacgcccacggcgcagcgcagctcttccccaatccggaacgagcgcacctactggaatgatgttccatgcgatcgccggtcgaatgtggtgtgccagctaccaccgagagctccagggccgctgccgccccccaactcggacatcaatgcgatcgagtacgtcggcaccctgcgcggcatccgttacgtgatgtacagccaacagctgagctgggctcagtccaaggcgtactgcgaggcaaacggccagacgctggcggacttcgtgacctcggatgagctggatggtatggtccgcggaattttccactacgtctacacgctgtctgatttcaacgacgccgtgctcaaaacttggaccggatacaacagccgaagtgctgactacagaggaaacagcatcctcactgcaaacagctttgccgcgaagtccaccacgggctattacgcaccgacccagttggcgtctggttcctgctacggccttactctggatccgaagactcaggtgctgcagcgcctgttcgagccggtcgagtgcaccgaactcaggaggcccatctgccgttatgaccaggccctggcagcggctgcttatgagacgacgatcagcggccggcgcttcgcttatttcaaggaggagcgtacgtggggtcgcgcccgcgacgtatgcaggggcctgttccagggtgacattgctacattcaggactgatgcggaatgggcttccgtgaagacctggctaaacggcattttctggagcggacttgttgatactctgcaggtggacaacctgacccgacctctcaccggcactctacgcaacgctgcctggcttaacgccagcgagccaactgtcacctcggagtgtggttatgtggacattcgcgggacggtgcggccgtcagtggacagcttctggcgtgcctcgcggtgcaacatcacgcgccccttcctgtgcgcatactcaccgacgggggcgcctccacagaatcccgccacttatgttcccgcgaggtcgcaatttgagctggctacttcaattgccatgcgaattaaccgctacggctacacgtacacaatcatcacggatcccaagctcagaggcagttacgctgaggcccaatccatgtgcagcatgcttcccggcttccctggcggcatgttggcgaccttgttcagcgccgaggaccttgagtacttcagtcgtgtgggagcggtggccgagggagatgcgcccaacctgtgggtgggcttcggcgatctcctgagcccaggcttccccttctggatgagcagcaacgtggcgccgggcggcgacctgagcgagcaatggaggcgggacttcagccctgtcgcgactcttgaaccagtcacaaactccatggcgtgtggctaccttgacacatccagcgggcagctgcggcgcgacttctgcctcctacgcaagtatggcttcatctgcatgtcgccaggctcatacggcgaaacccagcatgttgccgtgacggagatgactggagatggcatgccagacgtggtagtcgcgacaaactgcccatgggataatggtgcaagtatcatcactttccagcagccggcccccgcctccttcagcaccgcggcggaccagctcattcgccccactctcacagcccgccactgcggcgacggtatccccctcatggccagggaggagtgtgacgagggcttcgacatcgaggaggtcatcacgtgggactttggttataacgcgacagtggccaagcctgctgcaacagccaaccgcaacggtcccggtgcgtgtgcgacgtcgtgcaagctgcagccgcgcttcgtggtgcaggccggcgcccgcgaggtgttcatcgccctgggctcgggcaacgacaccatcaagcacctcggcgtcaactacaacctgtacggccaggctcgcggcttccgcgagctggccgacccacctgactcgccgctggtgctggatggcttcaccaacatcactgccgataaccatgggtttgcatacgtgcacggcaagccccagcgccagttccctgccaacgaacccattgccatccacaagggtcgtgcactcatgcccgggactcctttccagttccgagcgttcatgcaaaccgacacctccaagcccgtgctgcccaactgggccaacgtcgaaactgccagcgtgtccgacccgtccttcatcaccgccacgtccacctgcggctgcacacccaccaaccccagcggccagccagtggacctgagcatcagacagcagggtggcgccgtggagttcagctgggtggtgggctcagcctgcgagagctccgtgtccatcacccgcagccttgtggatgaggtgaacaatgagctgctcaacaccaccacagtggcgcagctgtctatcggcctggcctgcggcacagcgtaccgcccctccaaggccgaggtggatgaagacatcgcgcgtgacaagctgcaggttggccggacgtaccgctactgcatcgtggtcacctctgccgccacgtccacctacttcctggacgcgaccaagccactggagcccatccgcttcgtaagcgagcccatttgccgtgacgtacgcattcagtggacctccaccatcaccggcgaggtccgcacgcgttacgacacgccggcccctggcgtacgcctgtcggcccgactaatcggcacaccctacgtggtgagcgccgtcacggacgacagcggccgctatgagctggtcatgcagacggatgtgtacaactgcgacccagtactggcgcccgaggagtgcctcaagcagcgcgtcagggcggtggccagtgcgcgcaccaagctgcgctcaggccgcatcctgctccatgacttcagcatcaatggccggccgggcgcagtgcagatgctggcactgcagcacttgcaggttcagcagagtgtgcgaatcttggatgaaagcgccatgcctatcaccggattcgtcaggtggccgggatcggaggcgaatcgcggctttgatcagacacgcggctgccccatcaccaacgcgcgcgtgtgcgctgtcactgcccgcgagaactcaagcgtcagttgcgcaatgagcgaccccgggacgggtgcgttcctgctggctgcgggcgttggctcgttcctgcggctggacgtcacgtacgagaaccacacatttgccatcaacatgctcggcaccgtcgatgttgatgacactggggcctttgagctcatggcgccaatctacgatgtcgatatccgcgacctgacccgccgcaccgtgcgcgtgggccttgtgggcgggcagtgtgaaatcaaactgggagccgccgtgctgcagttcagcgcctacgactgcgacctacagtcgggccagcgcgcgctggaccggcgtgtacgcttggacccgagcgtgccgtacacggacattgaggtaccagcattaccctgggacatatcctatgtgggcattgaggatgctgtgcccgacgtgagccccgaagcaatcgagcgattcctcaccatcaccaaccagatcacgggctttgtgaacctgacaattggtaccgacacggagctgttcgaccccactgctgcggacctcgacattggtgaagagcccgttctgcctgaaccgccagtcgtcaagttccagttcacagctcccaacgagatggaggtgcaggtgtgcaaggacttcaaaggctccctcatcaactgcggcgagttcagcctcaaccgccgttgcgacggcaacacctcgatcaacgcctaccaggctgtgtacagcgccttcgggccgcccgacacgtcattggtgaagaaggatgtgttgctgctgaagcgagctgcgcggtataagatgcgcatcaagctcttccagatgtacggcaggctccggtgcgacaacctgaagaccacagtgctggttcaggattccattggaggcgaggtggaggagaaccagtgcagcgtcaagcgccggggctgcgtgaagaatgttgggtttgatgagctgaccaacaccaccgagttcacctacgacctggtcccgggcgccattagctttgctgtcggcaccgcctacgcgctgccgctgtcggctgtggctgccagcccaggctggccttcgcgctccctgctattgtactccatcgtggagggcacccaatcccgcacgggcactggctacatcgagatccccatccccgtgcctctgctcatcttgcgcgacccgccgggcgaccgcagctatgccacgctggagggaagcatctccacagccgtcaagctgtcacaagtgacgcacgacaaacagacctgcggcggcgtgggcgatgatgaggtcttcagcaaggccatgccttgggtaaacttgctgaacgcggttcctttctccaagtttggtaaaacctccaagatcaacgaaggggtgatgaaggcaaccaaaagcgccgccaaggtcgcgaccgcacaggataagattaggagaggtgtcccgaagaccagtctgtggggccaggtgaaacggtttggcagcaagggggcagctgcacccgggaaggcggtgaaaggtgtggtgaagaaagtgaagtcatggacgggctctgggacgaagaaatcggatattgtcattggcggccaacgcaagggcgccgtgccagtcaagcagcaggagtgggtgagggcaacggctaaccgtggcgcaacaacggcaacgcaaacatcatccgcggcccaaaaaggcacccagctcccttcgtccctgaccaaggcggtgagcacagcgaagaaggttgttgacaaggtcgacgacagtctggagcaaatggctttgttctaccagaagtacttccaggagaacgccatcaagaagttctacgacgattaccacatcagcaagtacatcaaggtcctgaagcgcctgtacaagagcgatgctctcacgcctgaggacaccacgggcgagcagctgcaagaccctgatggacttgagatgggccgcggcgcgggtttgtcgtaccgcaagaccgaaaacggtggccagctggcattcgagctgtttgagggccttggagtgccgactgaccccgacacgctggctgccgtcattgctgaaatgaagaccctgggtgaagacgagagcgccgagctgcttgctgggctggtggagcagcgggactatgcgcgggatgccgttgaggaggaccccatgctgccaagtgtcaacctcattgacatgaacgtggccttcaaccgcgacccctacggcctgcgccctggctacaagcacctcggcaaggagacgtccaggatccccgacatctaccgtccccaggacaaggccgagttcaggttgcggtccggcggcttcagtggcctgaaccccatctgcgccaagcggcacattggtgtcgggtatgatctggacatcctctcgtgcgcgggcttgggttacatggtgtgcctgccatccatccgtgatcgaggccaggctggcatgcttactgatatggcctggtacaacgaagaggaggaggagtcgtactacaagctgaccatcaagcgcgaggagggtttcagcacgcctgaggagtccaccccagagctcaccgacggtggcggcgacatgattctggcgcccacgttcgccattatgttcatcctgcaggatgagctgaagttcgacacccgcacgtgcacaccaacggcacgcatgggcattcccggctgggacctgcaggagaacatgcatggcactgcctggcactctgtgcaccacatccgcaacgtagtcatccccgagctctcgagcaagtacgccgccgagatgtccaagccggccgctcagcagagccccgacatcctcgccaacatctaccagggcatgcgtggttgggaggatgtcatgacaatctacgatgagatgaacaccatggcaaagcagcaggaggagagctttcccaactacgtggtgggagaccaggagatcaacggaatggtgcagggcaccgtggaaggcgtgtggcaggcgacgctggacgaccaccccgacaggcacatggatgcctttgaggcccgctccattgacccagagcggctggagcaatcaccagtgtggaagctgggatactatgaaggcagtgagaagctcgcgcagctcatgctgcgtactcaggcgtacatggataacagcacttcggccggcaacatcgtggcgatgccccgcgccaaggcggccatgggcggcgtcgccaccggaaaacatgttgacatcctgcaagagaagtacggggtccagttcaacaccatgtccttcagcggtggtggcggcagctacagctaccgctttaagaccatgagcactatcagcaccaagatccagttccagatcagcttcaaggacatgtttggctggaagggcggcggaggcggtggtgttgggttctggattgagaccacggatgagaacctttacggtttcgagctcgagttcgactccagcctgctggaggagacggaccgcgagcgcaccgtgagcttcacgctcaaggacaaggacgtgggcgactccttcctggtcaaagtcaaacccgacatggcgtacggcacacccatgttcgagctgcttgcgggccgcagcaagtgcccatacgagcacggcacgctgcagcgtgaaggcgcggcggtgtctgtgctgggcggccagaatgtacagttcaacgtgaagcagggcacagaggcgctgtacgagctgctgattgagaaccagtccggcacagacgagcaggtggagctgcaactgggccccgacctggccaccaacaaccaatccatgtacgtccagctgatgggggcgccgtggatcgagcccgtggggttcagcctgcgcggccccttcgccgcacaaacgcgcgccctggtgtcagccaaatgcggcccgcgctacccctccgccagcatcgacatcgtcgccaagtccacctgtgacagctccgagctgtcgcgtacgcccctcacgctgcaatgcttcaccccctgccccgctgtcatgtggccgcaagagtggccgcagcagcagcccctcatctacaacctcagcgacattacagcaagcaagaccatccggctcaaggtcttcaaccccgcatactccatccagaaatggaacacccacccgcgcctcaacggcaccaacggcaccacttcgatcatcatcgagtacaccaacgtggtctcgggcggcggcatctggctgccggtgcgctacctcaacggcagccgggtggacttcagcaagatcgaggaccccgcctacggctacgccacctttgactggtcgccggcctctgtggtggacggcgagtacctgctgcgctacgtggcgtactgcgacatcctggtgggcggcggcaccgacagccgctacgagggcccctccatctccctgctggtggacaaggcgccgcccgtgcccagccgcttctcggcctggcccaacatgtcgtacgtgccgggagaccaactgttcgtggacttcactgagccgttggactgccgcaagcccttcgccttcggcgtggtggccacccagcgcgactcggcaggcagcaccttcatcatccccagcaccgacctgtacgccacgtgctcgggcaaccgcatcaacttccactgggactccatcaaccgccccacggcgctcatgcccaaccgcaccgtcaccatccagctgctcaacgtcaaggacctggcgggcaatgccgtgccgcgcgccatcaacctcaccttcgccaccggcacgctcaccgcaaacgcgcccgtgacgctcaactatgtactggggccgctgcccacgccggcgcgccgcctgctgttcgccgaccgctcgggggtgctgccggtgcagctggtcaaccgcctggcgctgcgggacgagtccgcggcggagagcctggaggcccttgtggagcagcgcatggaggcgcggcggcagctgctggcccgcgtggacggcgtgctgcagagctgcaccgccagcggcgaggcgctggcggcggtggcggccatgaccagcgcgcgcgggcggctgcaggccactgacctgctggaggatgaggacctgctgagcatgctggtggcggcagcgcgcgacaacagctcgtgcctgtccacccagctggcagccaacttcgcgcagctccgccgcgtctttgccgagaagggcatcgacgaccagctgcttgagggcgcgggtgaggaggagctccgcgcggtgcgggcggcggcaacggcgagggcggcgcgtatgggcctggcgcaagcgtgggaggcgtccgtggcagaggcgcagcgggagcaggcgaagctgctggcggcgagtgagcaggcgacgacggaggcgcaggagctgctggcgcacatgacagcagtctcggaggcagacggcgtccacccctacatcagcctggctgtctgcgtgctggtgagcaacgccgtggcgctgctgctggtgggcggcatctggcgctacaggaagcgcaacagcggcctgtcagaactcaattccaagaagcgcggcacaggtctgctgccgactcggcgccgccgcggcctggcggcgatcctgcggccgggtgctgcgagcagcggcagcaccggcgacggcggcagcagtgctggcgaccagcaccaggcgt

SEQ ID NO: 232 - DNA, 2382 bp, Chlamydomonas reinhardtii
atgggctcgtgcctctccgcctccgccgaggagggccacagtgctaagccgaagcaacgggataagcaacttacggtcaaagtgaagcgcccggactggcggcagcacccacttgcaaagcagttcaacctcatcaagcgtcttggcagaggcggctacagcgaggtgtggcacgcggtgcacaaggggacgggcgagacgcgggcgctcaaggtggtggcgctggatgacccggagctgctgcccggagacttggccattctgcgggctgaggccaagttcctgctgacgctggattgcccctacctcatcaagtgctatgagaccacacacgacggcgtccatctcttcctagtgctggaaatgctcacgggcggcgagctgcttgaccacatacacaaggtgcacaactacacggagcggcaggctgccaacctgttcgcgcaggtggtgtctgccatctcctacctgcacaacctcaacctgatgcaccgcgacatcaagcccgagaacgtcatgttcacggcgccagttaacgactgcgaggcggcgggggcgcccctgcgcgtcaaggtcatcgacctgggcatgtcggcgcaattcgaccccaaaaagcttgtacgggaggccaccggcacgcctggttttgccgcgcctgagctgttcaatggaggggcgcaaacgcccgcgtgcgacgtgtacagcctaggcgtagtgttgttcatcatgctgattggccggccgccgcactcgggcacagacatccgctacctgacctactctgacaagagcatcaaggacgctcccgggctccaggacgcgaggtaccgtgcgctgtcggccgacgccaaggacctgttgctgaagatgttggcggatgaccccaaggcccggccgacatgtctggaggtgttgaagcaccccttcatgacggcggatgaatccaacacggcagcgcaccgcgagattggggatgtggtgcggcgccgcatgagcgacctagcgcagctgaggcgcctgcacggcctgcgctatgctatgcacatgtcacgccccaccaccgaggccgacaagcgcgcgctagtagccaccatggcccagcggcagcatcgcctgggcgtgggcggcagcggcagcggcgacaacacgccgcgcggcggcgccggtgtcggcgccgacgacgccgcgcccgtgtgcgaccgcaacgcctaccgcagcgtcatctggaagagcttcctggcgcccatgaactccctgcgtggcctcagcggcacgcgcaagcaccccggcacgcccggcgccggctgcagcggcaacggcgccgcggccaggagcgccctcgtggcggcctcacccggcggggccatgttgcgggctgacctggtgcaagacgacggaggcgacgacgacgtggccgacggctgcgctggcctggtggacacggacggtgccggcggcggcttggatgcgatggcgtccgggccggatgtgatgtcggaccggccctgggcgggcgaccggcacagccggcagcggcggcacagcagcacgggcgcggggctggtgacgacccacatcgcagatatcatgctggcggtgcggaccagcagcgtggccaacatgcatgccgcgcgcaccagcgcgacgccgctcagcgccgcacaggcagcgcgcgctcagctggccgcactctcatcgaaatcgaagctgcaggcggcattggaaagctcggccagcggcccggacgcggcatcgggagatgtgccagctcagctagggacgctggcaatgcggggcggcggcatggatacgccgcggggcggcggcactggccgcacgtccacttccggtcttgcggggtcgggcccctggccggtgtctggcgccggcgccggcgccggcgccgcggcccctgctcccgcgccgtgccttgacaagatggcgcttgtcaacgcgctgcccgcgttgtcgcactgcgcaaccatgccagcagccatcatgcgcgactgcgagcgggagtgggatgcgggagcgtgcgccgcgacggccgccggggccaaggcgggcagggctggcaacggcggcagcgcgggcacgggcaacagcgatggagatgcgacgggcgctacttcggcggccccggcccggtcgcccacgtcaagtgatgtggcggagacgctcacggcgctgcaggaggcgctggtgcccaggtcgtggtccgccaacccagccatgtacgaggcgctgttagccatggacgcgatcatggagggcctcaatggaaacgcaagcgccctggtgtcccctcgcgcggcggcggctgcggcggctgcggttgcagcgcacgcgccgccagtgaagcagaccacaaccgctgcgtga

SEQ ID NO: 233 - DNA, 1113 bp, Chlamydomonas reinhardtii
atgcttcgcggctttcgccacacagggcgttcattggttaggagtgggcgagaagcgcccgtagcctgcccccttagggctatacgcagccaggggtcgcggcgacccgcgctgaatggtgccgcgcctttgccaccttcttcctcgcgcccgctgtccacacctcctcagtacgctcctagctacgttggtgtggtggaaaaggtggtcgaagccgaggagctgctcccactgccggcccaggagtcacctgccgatgacccttcgttggccaacccgctccagcggatggagcggttatcaaccggatggttcggtgtcatcatggagtttgagggcgtcgtggtggagacttcggaggagacacaccggcaagcgtggcttcaggttgctgacgagttccgctttcgcaagccgctcggtcagagccttcgccggataaagggcgtgcgcgacgaggttgtggtgtcccgcatcttcggctggacgcacaaccctagcgttgcccggcaagttgcgcagcggaaagctgagctgtatgagaccctcatgggcggacgtcagctcgcagccatgctggagacgcggccgtttctggagacgctgaagcggtacagcatccccgttgctctggcaacgccgctcagcgagtccaaagtgaaggatggcctgcagcggcacaaccttgcacaatacttcgacgcggtggtgacggcggaggacagcggctcagcggaggtggagttctactacgcctacgcagcaagcaagatccagcgcccacccatccgctgcgtcgtcgtgggggagtccaataccagcgttgaggcggcgcacgagctgggcatgaagtgcgtggtcgtgacaggcacgaaccccgtgttcgacttcacgggtgcagacctggtggtgcgcaacctgtcgcaactgtcattcatgaacatgaagcgcctgtttgcggaggagagccttgtggagtccaagctgaacccgctggaggagccagggcgcaaccaggcggacgacattgatgatgaggacgattacgcggatgacgacgatgaggggttccagcccatgcgcggagcgatggcgtttggtgggcggtggtaa

SEQ ID NO: 234 - DNA, 9873 bp, Chlamydomonas reinhardtii
atgccagcgtccaacggcgcggaccagggcactgcccccgggggcacgatggcgtatggcgttctgtcacgggagcagcgaaagcaaatgtttgggcttgactgcccggagcagctggagtggcggcactggaacccagggacggagtatgtgaagcagctggtgctgaagaacgtgagcacgtccgtgcttaagattcgcttcaagcagcccaccagcaaagccttcggcatggacttcccggagcccttcaagctgcggccaggcatgagccagccgctcaaggtggtgttccggccgctcaagcagcagcactacagcgacaatgtggagctgttcgtggggaacgtgtcctgcctggtgcccgtgcacgcctacacgcctgtgactcacatcgaggtgccgccggcgctggactttggcttcacgcctacaaaggagacggtgacggcgcagctgcccgtccgcaacacaggagacgtgcgggttgacgtgctgtggaagctggacgcgccgttctccatctcgccgctgttcgccagcctggcgcctggcgaggtggtggccttcaccgcctcctttacgcccccggaggcctgctcctacacagccagcgcggcctgccagctggagtcgggcgcagcggccatctgcaagatctccggcatcggcaagtttccgtacctgtcggtggagcaggcgggcgtggacttcggggcggtagtggtggggcagcgtgtggagcggctggtgcggttcggcaaccacagcgtggtgcccgcgcacttcgcggtcacgcacgacgaggcggggcccgacgacggcgtgttcaccgtggggccagccaggggcacgctgggcccggaggagtacagcatgctcaagctgtcctacacgccccgcgccaccggcacattcagcagcgagaccttccacatcggcaccgccggcggcaaccgcgtggcgctcaacctgcgcggcaccgcggtggcgccgctcgtgacgctctccacgcgcgccttcaactttggcaacgtggccgccggcgccaccgcctcgcgcgtgctgtacatccgcaaccactccgccgtgcccgtgccgtacgacttccaggtcgacccgctggacgtgttcgccatctcccgcacacgcggcgtgctggcccccgacagcaccgcgcacgtgaccatcacgttccggcccatggccggcctggccgccaacctgtggcgccgcgtgacgctgctgctcaaggacgccgagccgcagggtgtggacctggtggccaccgcctacaccgacaagagccggccgccgccgctgagccagcgccacgtggagcgctacatggcgcgcgtgctgtcgggcggcccggccgtggaggagtcacagctggactccaagccgccctccgcggccacgggcgccggcgggctggatggcgccagcgagggcggcgcagggccgctgttggcgggcggtggttttggcagcctgttgccgccgctgggtgacgcggcggagggcggggagggcgccgcgtccaagctgcttggccccgacggctggtcgctgctgttcggcggccaggacccggctgcggcgctgacggtggacagcgacgcgctggactttggcagctgctcgcgcctgagcgcatccgagtaccgctccgtgaccgtcaccaaccacacccccgccaagctgacggccttcgtgctggtgcccgaatgggccgacccgggcgcggcgcccggcgacgcgccgcagcgcgtgttccaggtgttccccgagtccgccgacatgcggccctacggccaggccacgttcaaggtggcgttccggccgccgcgcgacgccgcgttcttcagccagcagctggcgctggtggcgcacaccaagagccagcgcaacttccgactggtggcggagcaccaggtgctgccggcctggtgcgtgccgctgcgcgccaccggcaacaccttcctgcactccaaccccgagttcgggcccaaggtggagctgtccagccgggccgtggccttcccgccctgccgccccggcgagcgcgtgcaccagacgctgctcatcgccaacagcggcgacacgcccgtcgccttctcctttggcgccgcgggcgccgcgctgggcccgctgttctccgccaagccggcggcgggcgtggtgccgccgcagggccacgtgctggtggcgctgcgcttcgcgcccaccgacacgcggcccgccgccgccaacgcgctggtcaccttcaacggcgtggcgtcgaacgcggtgtcggtgtcgctgcgcggcgcggcgcacacgccgcgcctgaccaccgacctgccctcctccacgctctacttccggcccacttgcgtgggcgcctccagccagcgcgccgtgacgctgcacaaccccagccgcgtgcccgtggccttccgctggcgcctgccggcgcggctgcagggcctggtaacggtctcgcccgccgccggcgcgctgcgcggtaacgagtcagtgcagctgcagtggtccttcacgccggcggcgcagaagctgtacgaggcgcgcgcggcctgcctggttatgtcgccaccggaagcggcgaatggcaatgcagccggcgccaccgcctccgccgccagcctgtttcccggcgccgggctggcgacggggatcgagtggtacgagggcgcgggcgcgacggcggcgctggcgggcatgggcgaggaggaggcggcggacgcagtgctgctgagcctggtgggtgagggcacgcagggcgcggtggcgctggaaccgccgtcgctggagctgggcgacctgcgggtggggcacccggtgcggcggccgctgctgctgcagaactgcagcgacggcgtgttacgctacagcctggaggttggcccggcagaggacgaccagccgccggcgggcgacgccacgctcgtggacttcacggcggggctggacagtgcggcggagggcggcgtgggtggaggcgcgggcggcgcgggtggcgcggcgctggagtgctgggtggacgagcccgagggcgcgctgccggcgcgcgcgtccaaaacggtgatggtgacgctgttcccgcgctaccgcaagcgctacagcctgcaggtgcgctgccgcagcagcacagtggcgccgctgctcactgggcccaaccgcccgccgtcaggcggcgccggcccgcgccctctggacgccggcagcgaagctgccgcggcggcggccgccgccgccgcggccgcggctgcgccgctgcctccgccggtcattgcgccgctgactgccagcaccaccttccccacgctggaggtgacggacgtgtactgcgaggggctgccgaagcagctgctgtggcagctgctgggcctcaacgacctcaaccaccacctgcgcaccgaggtcaccgccacggagctgcgcctgcgggccgcgcaggaccgcggagcgctcaccaccgaggccgccagcgccgccatgcgccccttcctcatggagttcggcacgcacggcctgggcggccggccgcgtgtggtgcacgtagagatctccaaccccacgccgctgcccgcctcctggcagctgcactccttcgacgaccccgatggtgtggagctggagaactgggtggagcccggccgcccgcgcaccgagggcgagcgcatgcgcgacctcatcgccgagtacaagctgtttgagatgcggccgcgcagcggcgagctagagccgggcgcgcgctgcaccgtgaccatcgagttccggccctccgtggagggctccttcgagctgcccgtgtttctgcatatcacggatggcaagcggctgcggctgcagctgcaggccgtaaccacgcccgagccgctgcagctgctggcgctgccgccgccgctgcggacgttccggctggagcccgtggcgctgggcgagcgcgcgccgccgctgcagatgtacgtgctgcgcaacggcggcccggcgccgctgcactggcggctggacacggcgccgctggcggcgctggcggaggcgagctgggggcacccggtgctggagctggtggggccggaggagggcgacatcgaggagggcggcgtggcggccatcaactggcgcttctcgccgctggaggccaaggagtaccgggtcgaggtgccggtgctgctgggtgacggcggcattgaggtcatcgagctgctgggccgcggcttcgcgccgccgcccgcgccgccgcacggcgccgccgccgtgcagctcattggccccggcgccgccacctcgcccgcagcccccaccaccgccgccgaagacgacgacacgcccgcagcagcgctggattcggtgggcggcgacgcggaggcagaggcggcacgcgcggccgcggcggcggaccgggactggatcacttggcgcgggctgagctcggcacccagtgcgggcatggcggggcggctggcgctggtggaccacgacctggtgtcgctgggcgtcacccctgtgcgaggcctgacgcggcgcatcatcgtgctcaccaacaagtcgcgctacccgctggccttcgactgggacctgggctgcttggcgccgccgccgccgcccggcctggccgccacgcagcgcgccgccgcagccagcgccatgatggggctgggcggcggctcgctgctgcccgcctcacagctgcagctgctggcgggccggccgctgcagggcgccctggccatcagcccggccgccggcagcctggagccgggcgagcggctggtgtgccgcgtgtcgctgcacgccggcgtcacgccgcaggtgttcgagggcgaggtgcgctgccacgtgcgcatcgacgatgatgcggtggcggaggccgaggcggcggcggcggcagccgctgccgcaggcgccgccgccgtcgcggcggagctgccgttcgtggagcaggtggaggaggtgattgcggaggcgccggtgcgcgggccgccggcgccgccgccggctgtggcggcggcgcagcgcgccagccgcctgcgcagtcggctgccggtgcaccagtacatgacgacggcggtgcgcacgcgcatcgagccgctgaacgccgccttcaccgccaccatggaggcgcgcacgaggcggctggcggacgccacgcggccgccctcctggccggagccgcagtccatcagcgtgacgctgcgcggccgcatcctggacgagcggcagctcggcgcgctgcggtacgtgccgccgcacgagcgcgccgcggcgcgcgcggcggtggtggcgggcgcggcctgggtgccgccggccatggtgcccttctgggaggaggaggggcggtccacgcccgcggtgtctgcgcaacccagctcccagggcggtggtggctatggtgttggcggatatggtggcggctacggcagtggtggaagccagggcggggaggcgtcggtggcgccgtctggcggcgacccgggcggctactcgccgcgtggcggcatggcggattcgtggccgagcctggagccgggcctgggcatggaggagactgtggtggggccgccaacggtaggcctggacctcagcctcagcctgcagcacgccggaggggctggtggggcgccaggcggcgacggcgactccgactcccgacctggcacgccgtccatgacagcggcggcgcaccaccaccaccaccacccgcgccacgccggacccgctcccggctccggcacggctgaggtcatggaggtgaccttctccggcgaccagcagccgacaggcggcccgatgccatcgccaccgagcatcagcggcgcaccggacccagactccgccacgcctgacgacgacttcgccactagcgacgccgccgtcaatgccgcggcagcggtccgcgcggccggcggcggcatgggctcgccacagcctgtagaccccggcggctctgccgccgccgccgccagcgagctggcaccgccggcgctgccgccagcgccgccacgcggtggcgacatcgagtacgacgccctggtgtcggcccgtgaggtgctggcgggcttgtttgcagagctgatggaagacgcggacgtcgtgcgggccgtggcgttcctgccagagcacgaggtgcccagctttgctgaggtgcgggccacgccgccgccctgttacgaccccgcggtccgggcggctgcggaagcggcgcgggcagaggcagaggcgcgcgctgcggctgaggcggccaccaaggccgcggctgaggctgaggcggtggccgcccgcgcagcggcaatgttgggccccaagcatgaggccagcagcagtagcagcagtagcagcagcagcagcagcagttcctcttcctcatcttcttcctcgtcagcagcatcctcgccaggggcgtcgccaactggaaaggctcctgtcgtggaggcagccacgccgcgtctggtctccgcagtgggcggcatggcgccttcgcaaccagcgctggcgttgaggccggcgccgtccactccgccgcggacaccgccgaagccttcgcagggcgcggcattcgccataccggcggcagcggcgcaggcggcgacggagccgccggcgctcgaggacgagctggctgcggacaccgaactggcgcgagtgctggtggcgccggagtggcgtgcgtttgcggactttgtgctggagagtgcggtgctggggttgatgcaggagagcgcggcgggcgactgggagatgccggaggaggaggtgggccgcaccagcacccgcaccggcacctccggcacccgcaacccgaccagcaccgaaaccggcaccggaaccggcatcggcaccggcaccggcacctccggcacccgcaacccgaccagcaccggcaccggcaccagcaccggcaccggcaccggcaccggcaccggcaccggcaccggcaccggcaccggcacgaccttggggctggggaactcggccccggcgcacgaggatgaggaggagctggtgtttcggctgcagccgccgttccgggagcgcaccgactgtgccgctgccaaggagcggagcagggaggtggcaaagcacctggtcgcggaatttccgggcaacaaggccgagattgagatgcgggtgacacggagctgggaggagcgcagcgccttccccttcgcgggtctgtgggcgcgcgccaaggcggccggaggttccagcagtggaggcggaggcagatgcggaggcggcggaggcggtggcggcgcgggcaagggcgagcagctgctgtgtgcggcgctgctgcgcctgcacctggacgcgagggacagcaagaagagccttgtgcaggtgctctacatgtccaccatcccaaggcggcagcggcagggcctgggacgcctcctcacccggtgcctgcagcaggcggcgcacgaggcggggcagcagcacatgacggtggtgctggccggtccggacgtgcggcccttctggacaaagctggggttcgcggcgccggcccgtagctcacccgaggagctcgtgtgcagccagagcgccgcgagtgcggcggggcagaccaaggaggtttggctcgcgcacctgtcggcgctgcaacctgcagagctggggacagggaaagtgctgcgacaacagcccgggctgcggctgcggcgcgtggtgacggagctgggcggcaaggcagtggtggaggaacctgctggcagtagggggggaagcggagagggcagcggggagggcagcggagagggcagcggggagggcagcggggagggcagcggggaggacagcgtgcaggcggatgccgagcgggacgctgaggggcagcagcaagaggaagagggagaggaagaggacaaagagcaggagcaggaggaggagcgggaggaggagcggggggaggagcgggaggaggagcaggagcaggagcaaggcccgggcgaggaggtggaaacgcgcggccagggcgccgggccgtccagtgcggggcggaccagcggcaccgcgcggcagaaacgagaagcggcccgggctgcggctaagcgctcgggccggtcgcggaaacaggcgcgtgttgaagagcagggccagggcgagggaagtcagcccgcagtggagacggaggcgacagcggtgacaaacagccagcaggggcagtcacccgcagcccctcagcccaagagggcccggcgcagccagcctaagaaggaggtggcactcaagggcgccaagcctacgactccaaaccaacgtgcgtgggccctcatcttcacacacgttgccggcacgctgggtccccgtaatggcctgtacggacctggcatgttggtggaggagattgtgcgtggcggcctggcctgtcgcgacatgttcattgcgtctcgggcggggctggacgcgctggcggagggggtggaggccaagcagcatgcgtgcctgggcacgtacccaatgccgtcgctggattcctgggagacagcggagatggccatggttgggctggcgcgggacgctgacgcgtacctcaacatggactggcaactctgggaccgagtgctcggcaagccgctgaactgccacctctgggagctacggagagccatccgcttcctcaacctcgactggaaagcgggatgcttcttcgtgccggacatgtgcgaggacaagtccgagctggcagcggcgctgcacaagcacttccgtctgcccgagggcggcgtctgccccgtgcaggcgcggctgtgggtggcactgaggcaggagcggggtgccagccctttgaggtggccaggcggctcaggcgagctgttcggcgctctagaggccctggcgaaccgggccaaggacccgcgcgctgagcgggcctggcgccaggaggacgtccggagctgccgccggctggtggtcgcggagtttgggtgcgcggccgctgtcatggacgcgcaccgagtgctgcttgctcgtgaggaggagcagcaggagcagcctcctcagccgcaggcccaacaacccgcggaccagccgccgccaccgcagcagcgacagcagcagccgcagcaccagcaccagcagcagcagcaggtgcgcctgcagctggaagagcagcaacgtcgggaggcaggggaggcagaggatgcgcgctggaagagcgaggaggcgcgccgcaagacagaggacacgaagcggcagctggaggacaagcagcgcagcaaggaggacgcccgccggcagagtgaggacaacaggcgccgcaacgaggaccgccgcaggcagcaggaggatgagcggcggcggcaggaggacgaccggcgcgcgcaggctttggcgcggcgtgaccgggaggcgcaggcgcaggcgcaggcgcaggcgcaggcgcaggcgcaggcgcaggcgcaggcgcaggcgcaggcgcaggcgcaggcgcaggcgcaggcgcaggcgcaggcgcaggcgcaggcgcaggcgcaggcgcaggcgcaggcacaggcgcaggcgcagacgcaggcgcaggcgcagacgcaggcgcaggcgcaggcgcagacgcagacgcagacgcagacacaaacgctgccgcagccgcagccgcagccgcagcggaatctgctacccttgcctgatcccagggacgcgccggcagcattgcgcgcagcggtgcagggctatgaggagcggcgactggacttcctggcctacaagatggagcgacacgacggcggcggcaagcagcgacttctcgaacgcttgcactgtgcctgcggcggctggccacatccttcatgctggctggtgctgtgctccacctgctgcaaggcgctgcccaagcaggcgggctgctgccccgccggggcgcactag

SEQ ID NO: 235 - DNA, 127 bp, Artificial Sequence
  amiRNA cloning fragment
gatctgagatcttggccggtcttcttcgaataatctcgctgatcggcaccatgggggtggtggtgatcagcgctattatacgaagaagaccggccaagatcttcgtgccgcccggctgcggaggtgg

SEQ ID NO: 236 - DNA, 127 bp, Artificial Sequence
  amiRNA cloning fragment
gatctgagatctttggtaagcatggaggtaaaatctcgctgatcggcaccatgggggtggtggtgatcagcgctatttttcctccatgcttaccaaagatcttcgtgccgcccggctgcggaggtgg

SEQ ID NO: 237 - DNA, 127 bp, Artificial Sequence
  amiRNA cloning fragment
gatctgagatctaaggacagttggatcactttatctcgctgatcggcaccatgggggtggtggtgatcagcgctataaactgatccaactgtccttagatcttcgtgccgcccggctgcggaggtgg

SEQ ID NO: 238 - DNA, 127 bp, Artificial Sequence
  amiRNA cloning fragment
gatctgagatctcagtctctcgaagtcactttatctcgctgatcggcaccatgggggtggtggtgatcagcgctataaactgacttcgagagactgagatcttcgtgccgcccggctgcggaggtgg

SEQ ID NO: 239 - DNA, 127 bp, Artificial Sequence
  amiRNA cloning fragment
gatctgagatctttggcggaaagttcttgcaaatctcgctgatcggcaccatgggggtggtggtgatcagcgctatttgtgagaactttccgccaaagatcttcgtgccgcccggctgcggaggtgg

SEQ ID NO: 240 - DNA, 127 bp, Artificial Sequence
  amiRNA cloning fragment
gatctgagatctgcgtagtacattctgtagatatctcgctgatcggcaccatgggggtggtggtgatcagcgctatatcaacagaatgtactacgcagatcttcgtgccgcccggctgcggaggtgg

SEQ ID NO: 241 - DNA, 36 bp, Artificial Sequence
  PCR primer
  misc_feature (21)..(30): N is A, C, T or G
taatacgactcactatagggnnnnnnnnnnaccggt

SEQ ID NO: 242 - DNA, 36 bp, Artificial Sequence
  PCR primer
  misc_feature (21)..(30): N is A, C, T or G
taatacgactcactatagggnnnnnnnnnnggtacc

SEQ ID NO: 243 - DNA, 34 bp, Artificial Sequence; identical to SEQ ID NO: 88
  PCR primer

SEQ ID NO: 244 - DNA, 28 bp, Artificial Sequence
  PCR primer
agatctcagctggaacactgcgcccagg

SEQ ID NO: 245 - DNA, 42 bp, Artificial Sequence; identical to SEQ ID NO: 91
  PCR primer

SEQ ID NO: 246 - DNA, 33 bp, Artificial Sequence; identical to SEQ ID NO: 89
  PCR primer

SEQ ID NO: 247 - DNA, 336 bp, Artificial Sequence
  synthesized
ggtgttgggtcggtgtttttggtcttggttggggtgttggtggtgctggtggaacatgtcaacatgcccaggaaaccaaggcgcgctacgttcctgggcgcagtgttccagctgcagtacacctggtcccgctatttgaatctcgctgatcggcaccatgggggtggtggtgatcagcgctattcaggtagcgggaccaggtgtactgcagccggaacactgccaggaaggagggggaggctgggtgggagaagcggtgtggggcggattagccttggagaccgattgctttgggttagtttgggctggcatagtttgggctggcttagttacacc

What is claimed is:

1. A genetically modified non-vascular photosynthetic organism comprising at least one RNAi agent, said at least one RNAi agent comprising an antisense nucleotide sequence that is complementary to the mRNA transcribed from SEQ ID NO. 115 or a sequence having at least 95% identity thereto; wherein said non-vascular photosynthetic organism has an increased growth rate in an aqueous environment containing between about 75 mM and 275 mM sodium chloride as compared to a genetically unmodified non-vascular photosynthetic organism of the same species lacking said at least one RNAi agent; and wherein said photosynthetic organism is at least one of *Chlamvdomonas* sp, *Volvacales* sp, *Dunaliella* sp, *Scenedesmus* sp, *Chloralla* sp, *Hematococcus* sp., *Volvox* sp, or *Nannochloropsis* sp.

2. The genetically modified organism of claim 1, wherein said at least one RNAi agent is a microRNA (miRNA).

3. The genetically modified organism of claim 1, wherein said at least one RNAi agent is a small interfering RNA (siRNA).

4. The genetically modified organism of any one of claims 1-3, wherein activity of a protein encoded by SEQ ID NO. 115 or a sequence having at least 95% sequence identity to said protein is decreased as compared to the activity of said protein in a genetically unmodified non-vascular photosynthetic organism of the same species lacking said at least one RNAi agent; and wherein said photosynthetic organism is at least one of *Chlamvdomonas* sp, *Volvacales* sp, *Dunaliella* sp, *Scenedesmus* sp, *Chloralla* sp, *Hematococcus* sp., *Volvox* sp, or *Nannochloropsis* sp.

5. The genetically modified organism of claim 4, wherein said activity is decreased by at least 10%.

6. The genetically modified organism of claim 4, wherein said activity is decreased by at least 20%.

7. The genetically modified organism of claim 4, wherein said activity is decreased by at least 30%.

8. The genetically modified organism of claim 4, wherein said activity is decreased by at least 40%.

9. The genetically modified organism of claim 4, wherein said activity is decreased by at least 50%.

10. The genetically modified organism of claim 4, wherein said activity is decreased by at least 60%.

11. The genetically modified organism of claim 4, wherein said activity is decreased by at least 70%.

12. The genetically modified organism of claim 4, wherein said activity is decreased by at least 80%.

13. The genetically modified organism of claim 4, wherein said activity is decreased by at least 90%.

14. The genetically modified organism of claim 4, wherein said activity is decreased by 100%.

15. The genetically modified organism of any one of claims 1-3, wherein the growth rate of said genetically modified organism is at least 10% greater than said genetically unmodified non-vascular photosynthetic organism of the same species lacking said at least one RNAi agent.

16. The genetically modified organism of any one of claims 1-3, wherein the growth rate of said genetically modified organism is at least 20% greater than said genetically unmodified non-vascular photosynthetic organism of the same species lacking said at least one RNAi agent.

17. The genetically modified organism of any one of claims 1-3, wherein the growth rate of said genetically modified organism is at least 40% greater than said genetically unmodified non-vascular photosynthetic organism of the same species lacking said at least one RNAi agent.

18. The genetically modified organism of any one of claims 1-3, wherein the growth rate of said genetically modified organism is at least 60% greater than said genetically unmodified non-vascular photosynthetic organism of the same species lacking said at least one RNAi agent.

19. The genetically modified organism of any one of claims 1-3, wherein the growth rate of said genetically modified organism is at least 80% greater than said genetically unmodified non-vascular photosynthetic organism of the same species lacking said at least one RNAi agent.

20. The genetically modified organism of any one of claims 1-3, wherein the growth rate of said genetically modified organism is at least 100% greater than said genetically unmodified non-vascular photosynthetic organism of the same species lacking said at least one RNAi agent.

21. The genetically modified organism of any one of claims 1-3, wherein the growth rate of said genetically modified organism is at least 150% greater than said genetically unmodified non-vascular photosynthetic organism of the same species lacking said at least one RNAi agent.

22. The genetically modified organism of any one of claims 1-3, wherein the growth rate of said genetically modified organism is at least 200% greater than said genetically unmodified non-vascular photosynthetic organism of the same species lacking said at least one RNAi agent.

23. The genetically modified organism of any one of claims 1-3, wherein the growth rate of said genetically modified organism is at least 250% greater than said genetically unmodified non-vascular photosynthetic organism of the same species lacking said at least one RNAi agent.

24. The genetically modified organism of any one of claims 1-3, wherein the growth rate of said genetically modified organism is at least 300% greater than said genetically unmodified non-vascular photosynthetic organism of the same species lacking said at least one RNAi agent.

25. The genetically modified organism of any one of claims 1-3, wherein the growth rate of said genetically modified organism is at least 350% greater than said genetically unmodified non-vascular photosynthetic organism of the same species lacking said at least one RNAi agent.

26. The genetically modified organism of any one of claims 1-3, wherein the growth rate of said genetically modified organism is at least 400% greater than said genetically unmodified non-vascular photosynthetic organism of the same species lacking said at least one RNAi agent.

27. The genetically modified organism of any one of claims 1-3, wherein the growth rate of said genetically modified organism is at least 450% greater than said genetically unmodified non-vascular photosynthetic organism of the same species lacking said at least one RNAi agent.

28. The genetically modified organism of any one of claims 1-3, wherein the growth rate of said genetically modified organism is at least 500% greater than said genetically unmodified non-vascular photosynthetic organism of the same species lacking said at least one RNAi agent.

29. The genetically modified organism of any one of claims 1-3, wherein said transcribed mRNA is decreased as compared to said genetically unmodified non-vascular photosynthetic organism of the same species lacking said at least one RNAi agent.

30. The genetically modified organism of claim 29, wherein said transcribed mRNA is decreased by at least 10%.

31. The genetically modified organism of claim 29, wherein said transcribed mRNA is decreased by at least 20%.

32. The genetically modified organism of claim 29, wherein said transcribed mRNA is decreased by at least 30%.

33. The genetically modified organism of claim 29, wherein said transcribed mRNA is decreased by at least 40%.

34. The genetically modified organism of claim 29, wherein said transcribed mRNA is decreased by at least 50%.

35. The genetically modified organism of claim 29, wherein said transcribed mRNA is decreased by at least 60%.

36. The genetically modified organism of claim 29, wherein said transcribed mRNA is decreased by at least 70%.

37. The genetically modified organism of claim 29, wherein said transcribed mRNA is decreased by at least 80%.

38. The genetically modified organism of claim 29, wherein said transcribed mRNA is decreased by at least 90%.

39. The genetically modified organism of claim 29, wherein said transcribed mRNA is decreased by 100%.

40. The genetically modified organism of any one of claims 1-3, wherein a protein encoded by said transcribed mRNA is decreased as compared to the protein encoded by said transcribed mRNA in said genetically unmodified non-vascular photosynthetic organism lacking said at least one RNAi agent.

41. The genetically modified organism of claim 40, wherein said protein is decreased by at least 10%.

42. The genetically modified organism of claim 40, wherein said protein is decreased by at least 20%.

43. The genetically modified organism of claim 40, wherein said protein is decreased by at least 30%.

44. The genetically modified organism of claim 40, wherein said protein is decreased by at least 40%.

45. The genetically modified organism of claim 40, wherein said protein is decreased by at least 50%.

46. The genetically modified organism of claim 40, wherein said protein is decreased by at least 60%.

47. The genetically modified organism of claim 40, wherein said protein is decreased by at least 70%.

48. The genetically modified organism of claim 40, wherein said protein is decreased by at least 80%.

49. The genetically modified organism of claim 40, wherein said protein is decreased by at least 90%.

50. The genetically modified organism of claim 40, wherein said protein is decreased by 100%.

51. The genetically modified organism of any one of claims 1-3, wherein said sodium chloride in said aqueous environment is between 100 mM and 250 mM.

52. The genetically modified organism of any one of claims 1-3, wherein said sodium chloride in said aqueous environment is between 100 mM and 200 mM.

53. The genetically modified organism of any one of claims 1-3, wherein said sodium chloride in said aqueous environment is between 75 mM and 175 mM.

54. The genetically modified organism of any one of claims 1-3, wherein said sodium chloride in said aqueous environment is between 75 mM and 150 mM.

55. The genetically modified organism of any one of claims 1-3, wherein said sodium chloride in said aqueous environment is between 100 mM and 275 mM.

56. The genetically modified organism of any one of claims 1-3 wherein said sodium chloride in said aqueous environment is between 150 mM and 275 mM.

57. The genetically modified organism of any one of claims 1-3, wherein said sodium chloride in said aqueous environment is between 200 mM and 275 mM.

* * * * *